United States Patent
Misaghi et al.

(10) Patent No.: US 11,634,836 B2
(45) Date of Patent: Apr. 25, 2023

(54) RANDOMIZED CONFIGURATION TARGETED INTEGRATION OF NUCLEIC ACIDS

(71) Applicant: GENENTECH, INC., South San Francisco, CA (US)

(72) Inventors: Shahram Misaghi, South San Francisco, CA (US); Bradley R. Snedecor, South San Francisco, CA (US)

(73) Assignee: Genentech, Inc., South San Francisco, CA (US)

(*) Notice: Subject to any disclaimer, the term of this patent is extended or adjusted under 35 U.S.C. 154(b) by 0 days.

(21) Appl. No.: 17/562,950

(22) Filed: Dec. 27, 2021

(65) Prior Publication Data

US 2022/0119985 A1    Apr. 21, 2022

Related U.S. Application Data

(63) Continuation of application No. PCT/US2020/039753, filed on Jun. 26, 2020.

(60) Provisional application No. 62/991,708, filed on Mar. 19, 2020, provisional application No. 62/866,893, filed on Jun. 26, 2019.

(51) Int. Cl.
| | |
|---|---|
| *C40B 30/06* | (2006.01) |
| *C07K 16/00* | (2006.01) |
| *C12N 15/85* | (2006.01) |
| *C12N 15/90* | (2006.01) |
| *C40B 40/02* | (2006.01) |

(52) U.S. Cl.
CPC ............ *C40B 30/06* (2013.01); *C07K 16/005* (2013.01); *C12N 15/85* (2013.01); *C12N 15/907* (2013.01); *C40B 40/02* (2013.01); *C07K 2317/14* (2013.01); *C07K 2317/31* (2013.01)

(58) Field of Classification Search
None
See application file for complete search history.

(56) References Cited

U.S. PATENT DOCUMENTS

| | | |
|---|---|---|
| 7,126,041 B1 | 10/2006 | Helmer et al. |
| 8,748,129 B2 | 6/2014 | Nicaud et al. |
| 9,816,110 B2 | 11/2017 | Shen et al. |

(Continued)

FOREIGN PATENT DOCUMENTS

| | | |
|---|---|---|
| WO | WO 92/08796 A1 | 5/1992 |
| WO | WO 94/28143 A1 | 12/1994 |

(Continued)

OTHER PUBLICATIONS

Carter, "Introduction to current and future protein therapeutics: A protein engineering perspective," Experimental Cell Research 317:1261-1269 (2011).

(Continued)

*Primary Examiner* — Christian C Boesen
(74) *Attorney, Agent, or Firm* — Baker Botts L.L.P.

(57) ABSTRACT

The presently disclosed subject matter relates to "Randomized Configuration Targeted Integration" (also referred to herein as "Randomized Chain Targeted Integration") (RCTI) strategies for the generation and identification of host cells capable of expressing recombinant proteins, e.g., monoclonal antibodies, as well as compositions derived from the same, e.g., bispecific antibodies, and other complex format proteins, e.g., membrane protein complexes and other difficult to express molecules.

49 Claims, 12 Drawing Sheets

Specification includes a Sequence Listing.

(56) References Cited

U.S. PATENT DOCUMENTS

| | | | |
|---|---|---|---|
| 2010/0154069 A1 | 6/2010 | Mikkelsen et al. | |
| 2016/0145645 A1 | 5/2016 | Bahr et al. | |

FOREIGN PATENT DOCUMENTS

| | | | |
|---|---|---|---|
| WO | WO 2015/073703 A1 | 5/2015 | |
| WO | WO 2017/184832 A1 | 10/2017 | |
| WO | WO 2019/126634 A2 | 6/2019 | |
| WO | WO 2020/132165 A1 | 6/2020 | |

OTHER PUBLICATIONS

Clackson et al., "Making antibody fragments using phage display libraries," Nature 352:624-628 (1991).

Crawford et al., "Fast Identification of Reliable Hosts for Targeted Cell Line Development from a Limited-Genome Screening Using Combined φC31 Integrase and CRE-Lox Technologies," Biotechnol Prog 29:1307-1315 (2013).

Dillon et al., "Efficient production of bispecific IgG of different isotypes and species of origin in single mammalian cells," mAbs 9:213-230 (2017).

Graham et al., "Characteristics of a Human Cell Line Transformed by DNA from Human Adenovirus Type 5," J. Gen Virol 36:59-72 (1977).

Hsu et al., "Advanced microscale bioreactor system: a representative scale-down model for bench-top bioreactors," Cytotechnology 64:667-678 (2012).

International Search Report dated Oct. 13, 2020 in International Application No. PCT/US2020/039753.

Kindt et al., Kuby Immunology, $6^{th}$ed., W.H. Freeman and Co., p. 91 (2007).

Mather et al., "Culture of Testicular Cells in Hormone-Supplemented Serum-Free Medium," Annals, N.Y. Acad. Sci. 383:44-68 (1982).

Mather, "Establishment and Characterization of Two Distinct Mouse Testicular Epithelial Cell Lines," Biol. Reprod. 23:243-252 (1980).

Portolano et al., "Lack of Promiscuity in Autoantigen-Specific H and L Chain Combinations as Revealed by Human H and L Chain Roulette" J. Immunol. 150:880-887 (1993).

Williams et al., "Improving Stepwise Assembly of a Bispecific F(ab')2 from Two Different Fab' Molecules," Ind Eng Chem Res 56:1713-1722 (2017).

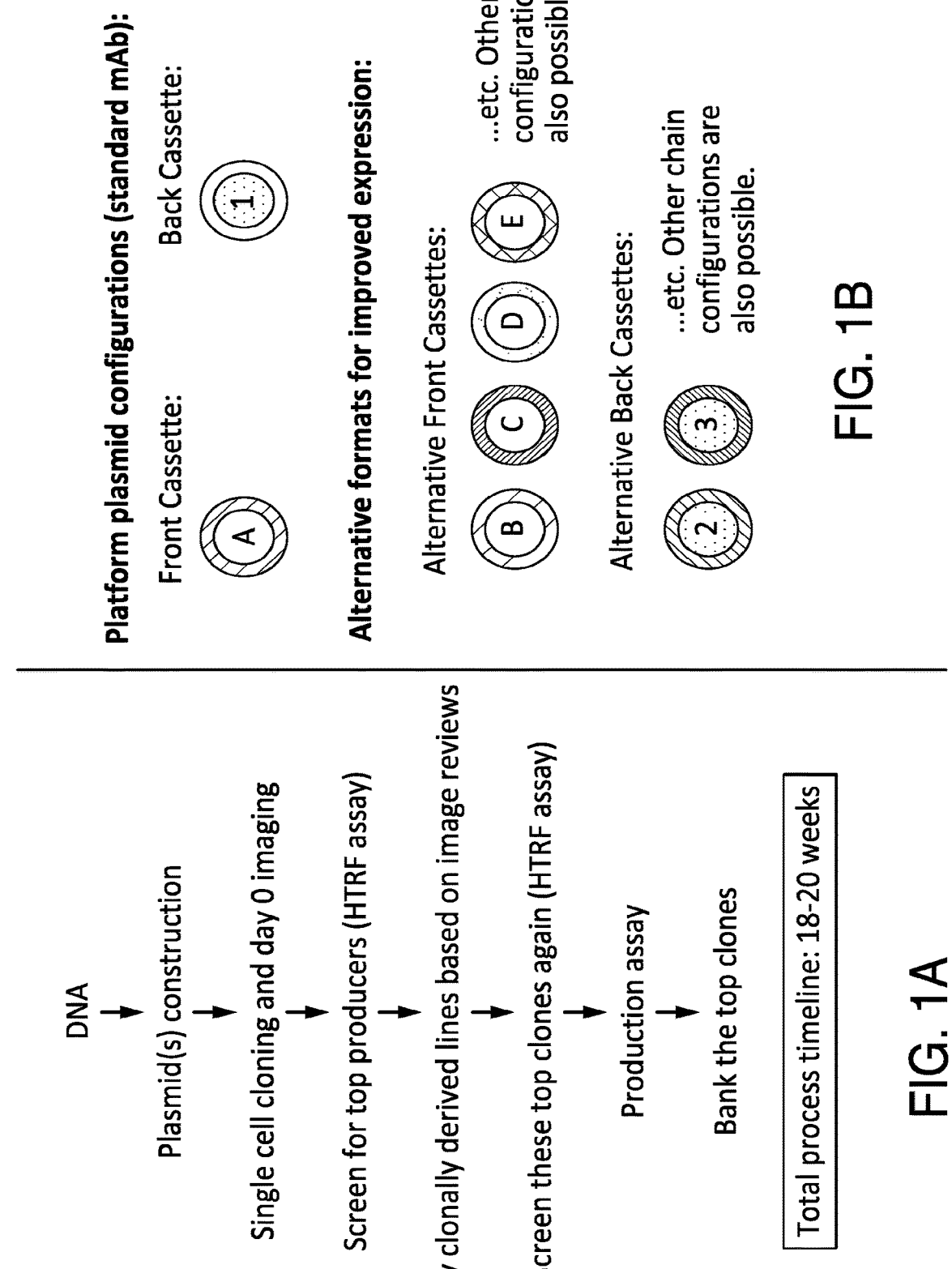

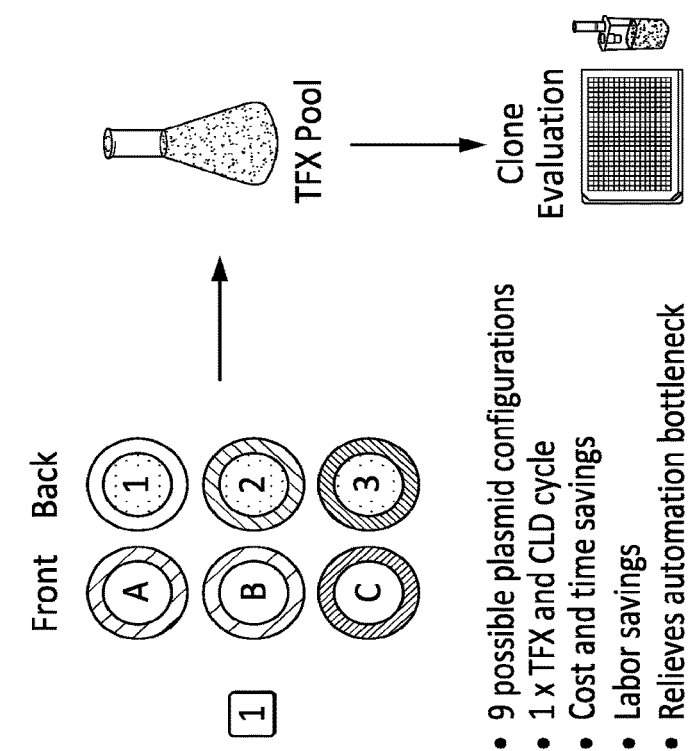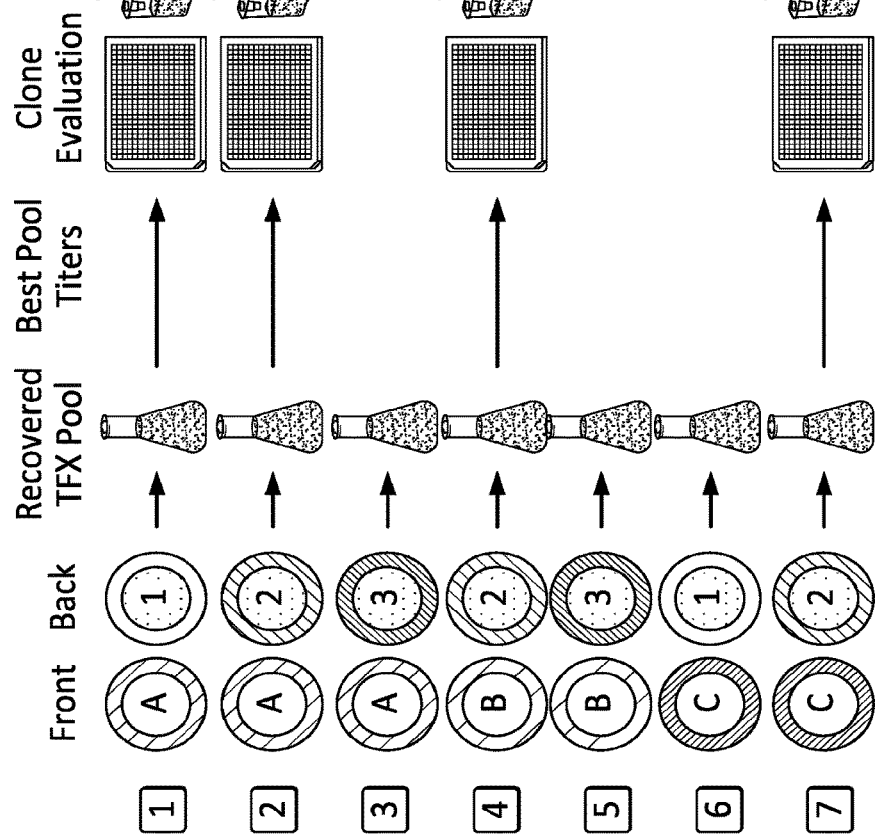
FIG. 2A
FIG. 2B

|  | Growth and Productivity | | | Change Variants | | | Major Glycan Species | | | |
|---|---|---|---|---|---|---|---|---|---|---|
|  | D14 IVCC (10⁸ cell-d/L) | D14 % Viability | D14 Qp (pg-cell/d) | % Acidics | % Main Peak | % Basics | Man5 | G1 | G0 | G0F |
| Std CLD: Min | 640.6 | 15.0 | 1.9 | 28.2 | 51.4 | 0.7 | 0.3 | 0.3 | 0.5 | 42.9 |
| Std CLD: Max | 2168.0 | 98.5 | 53.8 | 47.0 | 68.8 | 7.9 | 2.4 | 1.7 | 3.2 | 72.3 |
| RCTI: Min | 668.3 | 46.2 | 10.8 | 26.6 | 53.3 | 0.0 | 0.3 | 0.6 | 0.5 | 48.4 |
| RCTI: Max | 2846.4 | 97.8 | 45.6 | 42.8 | 69.4 | 6.0 | 2.8 | 3.8 | 4.5 | 69.2 |

FIG. 4

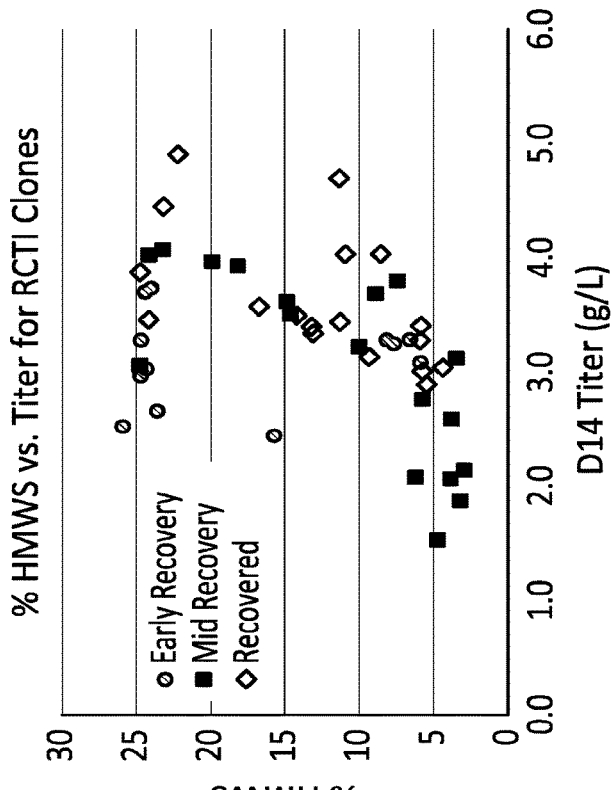
FIG. 6A
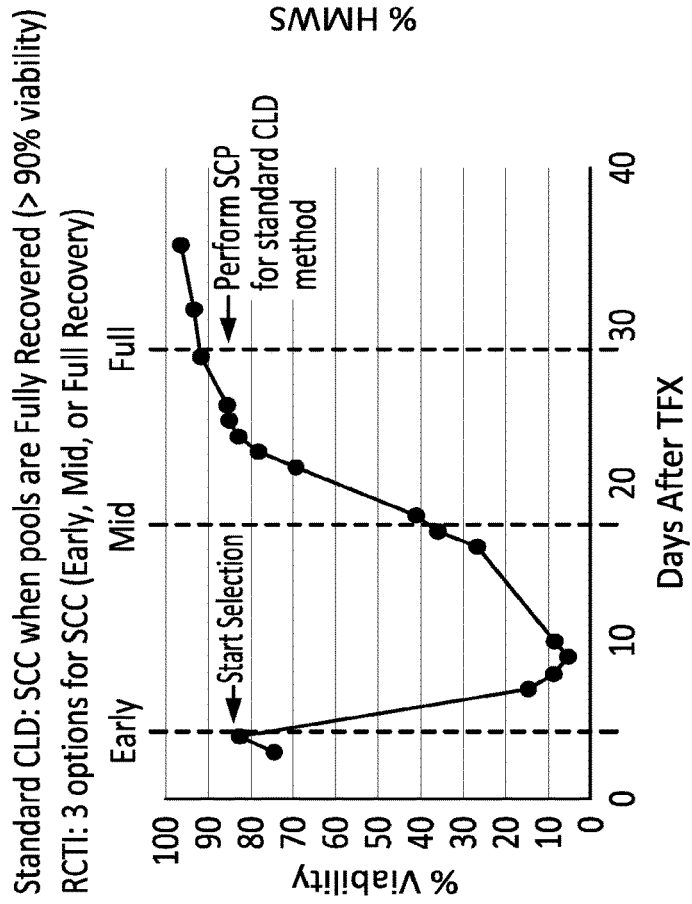
FIG. 6B
| Recovery | Timeline Savings | Clone Performance[a] | Clone Heterogeneity[b] |
|---|---|---|---|
| Early | +++ | ++ | +++ |
| Mid | ++ | ++ | +++ |
| Full | + | +++ | +++ |
[a] Percentage of clones with > 3 g/L D14 titer
[b] Range of % HMWS and D14 titer produced by clones
FIG. 6C

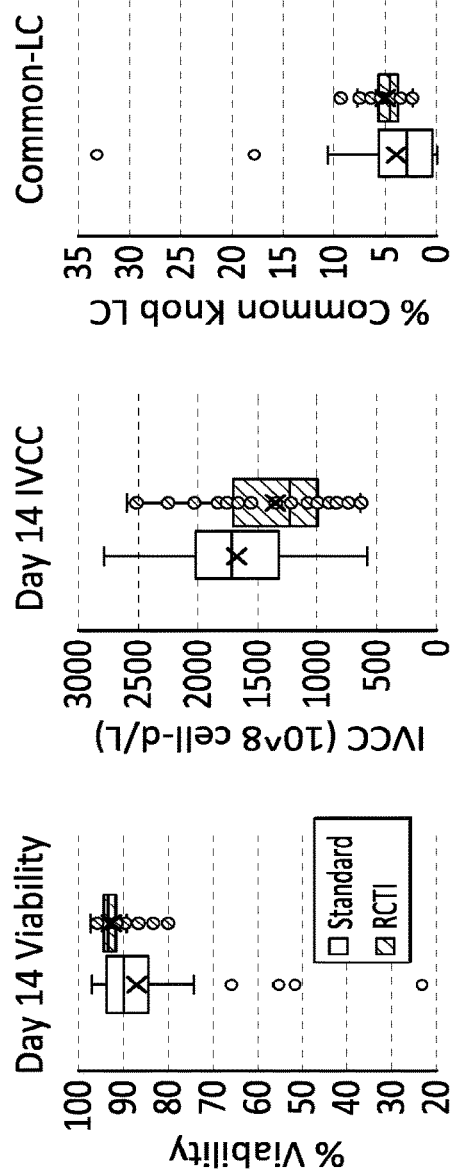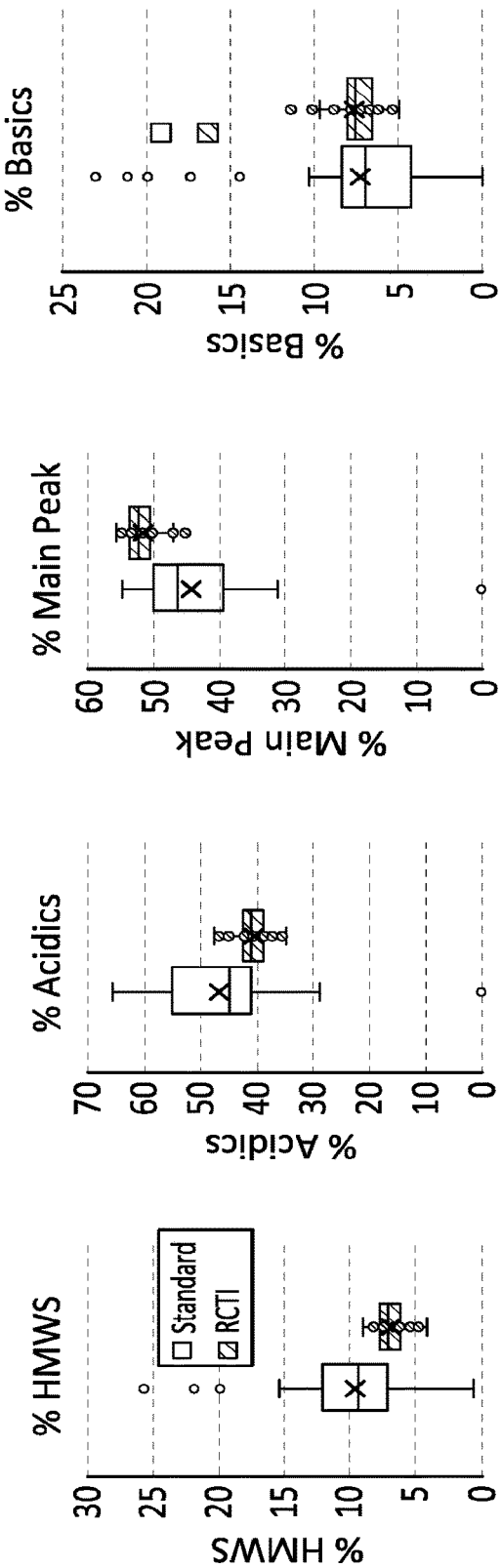

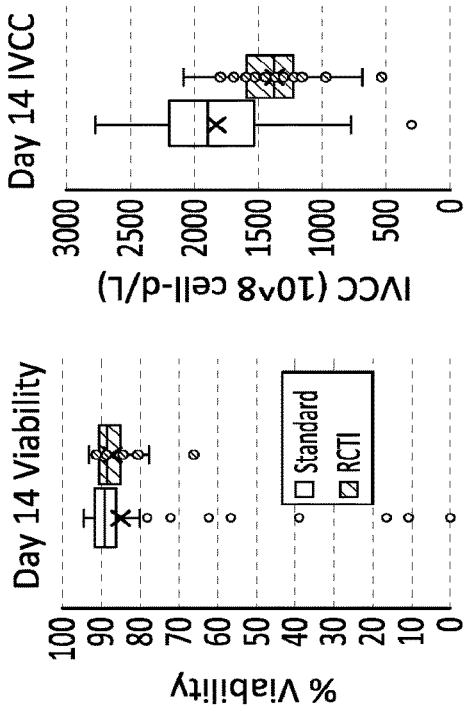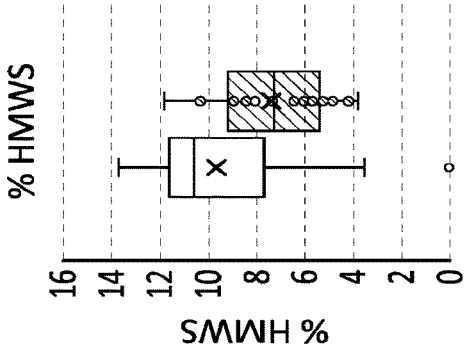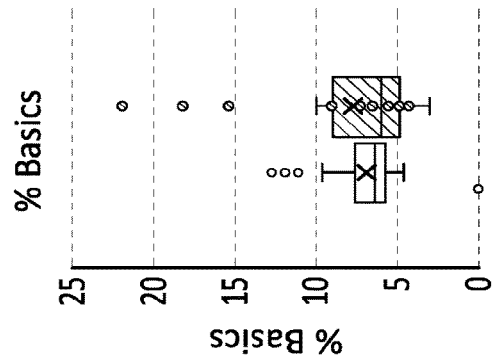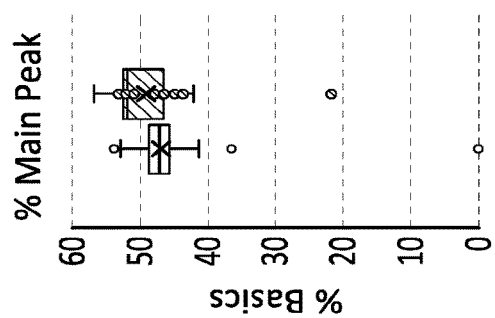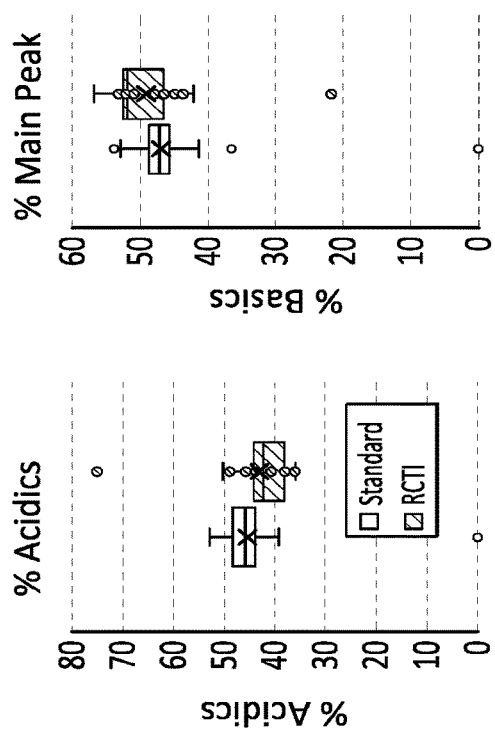

mAb A
An antibody with high propensity to form aggregates

Molecule-Y
A bispecific antibody with high titer demands

Molecule-Z
A challenging to express chimeric antibody/ligand protein

RANDOMIZED CONFIGURATION TARGETED INTEGRATION OF NUCLEIC ACIDS

CROSS-REFERENCE TO RELATED APPLICATIONS

This application is a continuation of International Application No. PCT/US20/39753, filed on Jun. 26, 2020, which claims priority to U.S. Provisional Application No. 62/866,893, filed on Jun. 26, 2019, and U.S. Provisional Application No. 62/991,708, filed on Mar. 19, 2020, the contents of each of which are incorporated by reference herein in their entirety, and to each of which priority is claimed.

TECHNICAL FIELD

The presently disclosed subject matter relates to "Randomized Configuration Targeted Integration" (also referred to herein as "Randomized Chain Targeted Integration") (RCTI) strategies for the generation and identification of host cells capable of expressing recombinant proteins, e.g., monoclonal antibodies, as well as compositions derived from the same, e.g., bispecific antibodies, and other complex format proteins, e.g., membrane protein complexes, and other difficult to express molecules.

SEQUENCE LISTING

The present specification makes reference to a Sequence Listing (submitted electronically as a .txt file named "00B206_1166_SL.txt" on Dec. 27, 2021). The 00B206_1166_SL.txt file was generated on Dec. 27, 2021 and is 1,296,821 bytes in size. The entire contents of the Sequence Listing are hereby incorporated by reference.

BACKGROUND

Due to the rapid advancement in cell biology and immunology, there has been an increasing demand to develop novel therapeutic recombinant proteins, e.g., monoclonal antibodies, bispecific antibodies, and complex format proteins, for a variety of diseases including cancer, cardiovascular diseases, and metabolic diseases. These biopharmaceutical candidates are commonly manufactured by commercial cell lines capable of expressing the proteins of interest. For example, Chinese hamster ovary (CHO) cells have been widely adapted to produce therapeutic monoclonal or bispecific antibodies as well as more complex format proteins in recent years.

Conventional strategies for developing commercial cell lines generally involve repeated efforts directed to integrating a nucleotide sequence encoding the polypeptide of interest, either randomly or at a specific ("targeted") location, followed by the selection and isolation of cell lines producing that polypeptide. These approaches, however, have their own specific disadvantages. While the random integration methods offer the possibility of obtaining different clones with different compositions and ratios of transgenes intended for expression, it is time-consuming and resource-intensive to screen hundreds, or even thousands, of clones after transfection to isolate cell lines demonstrating desirable expression levels, product quality attributes, and production culture performance. Additionally, it is possible that clone(s) with an optimal ratio of various transgenes might either not be present or may not be isolated due to instability or the failure to screen a sufficient number of clones. Moreover, when producing multi-chain polypeptides, e.g., monoclonal antibodies, further screening to address the number and arrangement of nucleic acids encoding such polypeptides may be required. It is difficult, when using random integration methods, to determine the number and location of all of the transgenes introduced into the genome and their arrangements, which is an important step in making a rational correlation between the transgene arrangements/copy numbers and desired product attributes.

Targeted integration approaches, in contrast, can provide more control over the arrangement and copy numbers of each specific transgene, given that the transgene(s) are inserted in a predefined and specific location within the genome. Such targeted integration approaches, however, are designed to minimize the possibility of generating random combinations and ratios of different transgenes. Hence, if a designed arrangement and copy number of transgenes happen to be suboptimal, all of the derived clones would similarly have suboptimal product quality and/or titer. To increase the opportunity of expressing a complex or difficult to express molecule using the targeted integration approach, multiple different transgenes arrangements and copy number configurations are individually tested, resulting in increased cell line development (CLD) workload and resource requirements. Accordingly, there is a need in the art for new cell line development strategies that conserve resources while generating cell lines exhibiting expression levels, product quality attributes, and production culture performance comparable to conventional methodologies.

SUMMARY OF THE INVENTION

The presently disclosed subject matter relates to "Randomized Configuration Targeted Integration" (also referred to herein as "Randomized Chain Targeted Integration") (RCTI) strategies for the generation and identification of host cells capable of expressing recombinant proteins, e.g., monoclonal antibodies, as well as compositions derived from the same, e.g., bispecific antibodies, and other complex format proteins, e.g., membrane protein complexes and other difficult to express molecules. The RCTI methods described in the present disclosure can be used to screen the same number, if not more, vector configurations than the standard cell line development methods while using fewer resources. Fewer individual clones can be screened as well by using the RCTI methods described in the present disclosure.

In certain embodiments, the present disclosure provides a method for generating and high throughput screening a library of targeted integration (TI) host cells expressing at least one sequence of interest (SOI) that comprises: a) generating a library of TI host cells, wherein said library comprises a plurality of TI host cells expressing one or more SOIs, by: i) providing a plurality of TI host cells; ii) contacting the plurality of TI host cells with a plurality of vectors, wherein the vectors comprise one or more SOIs; iii) introducing the one or more SOIs into one or more of the plurality of TI host cells; b) separating said library into single clones; and c) screening the clones for a specific cellular or product attribute.

In certain embodiments, the present disclosure provides a method of generating a library of TI host cells comprising a plurality of exogenous nucleotide SOIs comprising: a) providing a plurality of TI host cells; b) contacting the plurality of TI host cells with a plurality of vectors, wherein the vectors comprise one or more SOIs; c)

introducing the one or more SOIs into one or more of the plurality of TI host cells. In certain embodiments, the one or more of the plurality of TI host cells comprises one or more exogenous nucleotide sequences integrated at one or more loci of the genome of the TI host cell, and the exogenous nucleotide sequence comprises at least two recombinase recognition sequences (RRSs), flanking at least one first selection marker. In certain embodiments, the vectors comprise: a) at least two RRSs matching the at least two RRSs on the integrated exogenous nucleotide sequence; and b) one or more exogenous SOI and at least one second selection marker flanked by said RRSs.

The presently disclosed subject matter also provides methods for RCTI of one or more exogenous nucleic acid into a host cell to facilitate the expression of a sequence of interest. In certain embodiments, such methods comprise the targeted integration of one or more exogenous nucleic acids into a host cell via recombinase-mediated integration or via gene editing-mediated integration. In certain embodiments, such methods relate to a cell comprising one or more exogenous nucleotide sequences integrated within a locus of the genome of the host cell, wherein the locus comprises a nucleotide sequence that is at least about 90% homologous to a sequence selected from SEQ ID Nos. 1-12.

In certain embodiments, the present disclosure provides a method of preparing a TI host cell expressing one or more SOIs comprising: a) providing a plurality of TI host cells; b) contacting the plurality of TI host cells with a plurality of vectors, wherein the vectors comprise one or more SOIs; c) introducing the one or more SOIs into one or more of the plurality of TI host cells; and d) selecting the TI host cells expressing the one or more SOIs. In certain embodiments, the one or more of the plurality of TI host cells comprises one or more exogenous nucleotide sequences integrated at one or more loci of the genome of the TI host cell, and wherein the exogenous nucleotide sequence comprises at least two RRSs, flanking at least one first selection marker. In certain embodiments, the vectors comprise: a. at least two RRSs matching the at least two RRSs on the integrated exogenous nucleotide sequence; and b. one or more exogenous SOI and at least one second selection marker flanked by said RRSs. In certain embodiments, the method comprises introducing into one or more of the plurality of TI host cells one or more recombinase or a nucleic acid encoding a recombinase, wherein the one or more recombinase recognizes the RRSs; and d) selecting for TI cells expressing the second selection marker to thereby isolate a TI host cell expressing the sequence of interest. In certain embodiments, the exogenous nucleotide sequence comprises a first and a second RRS flanking at least one first selection marker, and a third RRS located between the first and the second RRS, and all the RRSs are heterospecific; and the plurality of vectors comprise: i. a first vector comprising two RRSs matching the first and the third RRS on the integrated exogenous nucleotide sequence and flanking at least one first exogenous SOI and at least one second selection marker; ii. a second vector comprising two RRSs matching the second and the third RRS on the integrated exogenous nucleotide sequence and flanking at least one second exogenous SOI; and selecting for TI cells expressing the second selection marker to thereby isolate a TI host cell expressing the first and second sequences of interest.

In certain embodiments, the present disclosure provides a method of expressing a SOI comprising: a) providing a plurality of TI host cells; b) contacting the plurality of TI host cells with a plurality of vectors, wherein the vectors comprise one or more SOIs; c) introducing the one or more SOIs into one or more of the plurality of TI host cells; and d) selecting for a TI host cell expressing the sequence of interest; e) culturing the cell in d) under conditions suitable for expressing the sequence of interest therefrom.

In certain embodiments, the present disclosure provides a method of expressing a SOI comprising: a) providing a plurality of TI host cells wherein each TI host cell comprises one or more exogenous nucleotide sequences integrated at one or more loci of the genome of the TI host cell, and wherein the exogenous nucleotide sequence comprises at least two RRSs, flanking at least one first selection marker; b) contacting the plurality of TI host cells with a plurality of vectors, wherein the vectors comprise: a. at least two RRSs matching the at least two RRSs on the integrated exogenous nucleotide sequence; and b. one or more exogenous SOI and at least one second selection marker flanked by said RRSs; c) introducing one or more recombinase or a nucleic acid encoding a recombinase, wherein the one or more recombinase recognizes the RRSs; d) selecting for TI cells expressing the second selection marker to thereby isolate a TI host cell expressing the sequence of interest; and e) culturing the cell in d) under conditions suitable for expressing the sequence of interest and recovering the product of the sequence of interest therefrom. In certain embodiments, the exogenous nucleotide sequence comprises a first and a second RRS flanking at least one first selection marker, and a third RRS located between the first and the second RRS, and all the RRSs are heterospecific; and the plurality of vectors comprises: i. a first vector comprising two RRSs matching the first and the third RRS on the integrated exogenous nucleotide sequence and flanking at least one first exogenous SOI and at least one second selection marker; ii. a second vector comprising two RRSs matching the second and the third RRS on the integrated exogenous nucleotide sequence and flanking at least one second exogenous SOI; and selecting for TI cells expressing the second selection marker to thereby isolate a TI host cell expressing the first and second sequences of interest.

In certain of the above described embodiments, the one or more SOIs are introduced into one or more of the plurality of TI host cells by recombinase-mediated integration. In certain of the above described embodiments, the one or more SOIs are introduced into one or more of the plurality of TI host cells by gene editing-mediated integration.

In certain of the above described embodiments, the one or more SOIs are operably linked to one or more regulatable promoters. In certain of the above described embodiments, the one or more regulatable promoters are selected from the group consisting of SV40 and CMV promoters.

In certain of the above described embodiments, the TI host cells are mammalian host cells. In certain of the above described embodiments, the TI host cells are hamster host cells, human host cells, rat host cells, or mouse host cells. In certain of the above described embodiments, the TI host cells CHO host cells, CHO K1 host cells, CHO K1SV host cells, DG44 host cells, DUKXB-11 host cells, CHOK1S host cells, or CHO KIM host cells.

In certain of the above described embodiments, the SOI encodes a polypeptide subunit, or fragment thereof, of a multisubunit protein. In certain of the above described embodiments, the SOI encodes a single chain antibody, an antibody light chain, an antibody heavy chain, a single-chain Fv fragment (scFv), or an Fc fusion protein.

In certain of the above described embodiments, the specific cellular attribute is selected from: cell growth, cell titer, specific productivity, volumetric productivity, clone stability. In certain of the above described embodiments, the specific product attribute is selected from: level of glycosylation, level of charge variance, reduced mismatch, reduced protein/peptide aggregation, protein sequence heterogeneity.

In certain of the above described embodiments, the one or more SOIs are introduced into one or more of the plurality of TI host cells at one or more loci that are at least about 90% homologous to a sequence selected from: SEQ ID Nos. 1-12; NW_006874047.1; NW_006884592.1; NW_006881296.1; NW_003616412.1; NW_003615063.1; NW_006882936.1; and NW_003615411.1.

In certain of the above described embodiments, the at least one sequence of interest comprises 2, 3, 4, 5, 6, 7, 8, 9, 10 sequences of interest.

BRIEF DESCRIPTION OF THE DRAWINGS

FIGS. 1A-1B are schematics illustrating exemplary targeted integration (TI) Cell Line Development (CLD) workflows.

FIGS. 2A-2B are schematics illustrating ex the comparison of standard TI and "Randomized Configuration Targeted Integration" (also referred to herein as "Randomized Chain Targeted Integration") (RCTI) workflows.

FIG. 4 shows other product quality attributes comparable between standard TI CLD and RCTI approaches.

FIGS. 6A-6C illustrate that RCTI methods provide improved timeline flexibility while maintaining clone performance.

FIGS. 8A-8G depict product quality attributes are comparable between standard CLD and RCTI approaches for Molecule-Y.

FIGS. 10A-10F depict product quality attributes comparable between standard CLD and RCTI approaches for Molecule-Z.

DETAILED DESCRIPTION

Figures 3A, 3B:
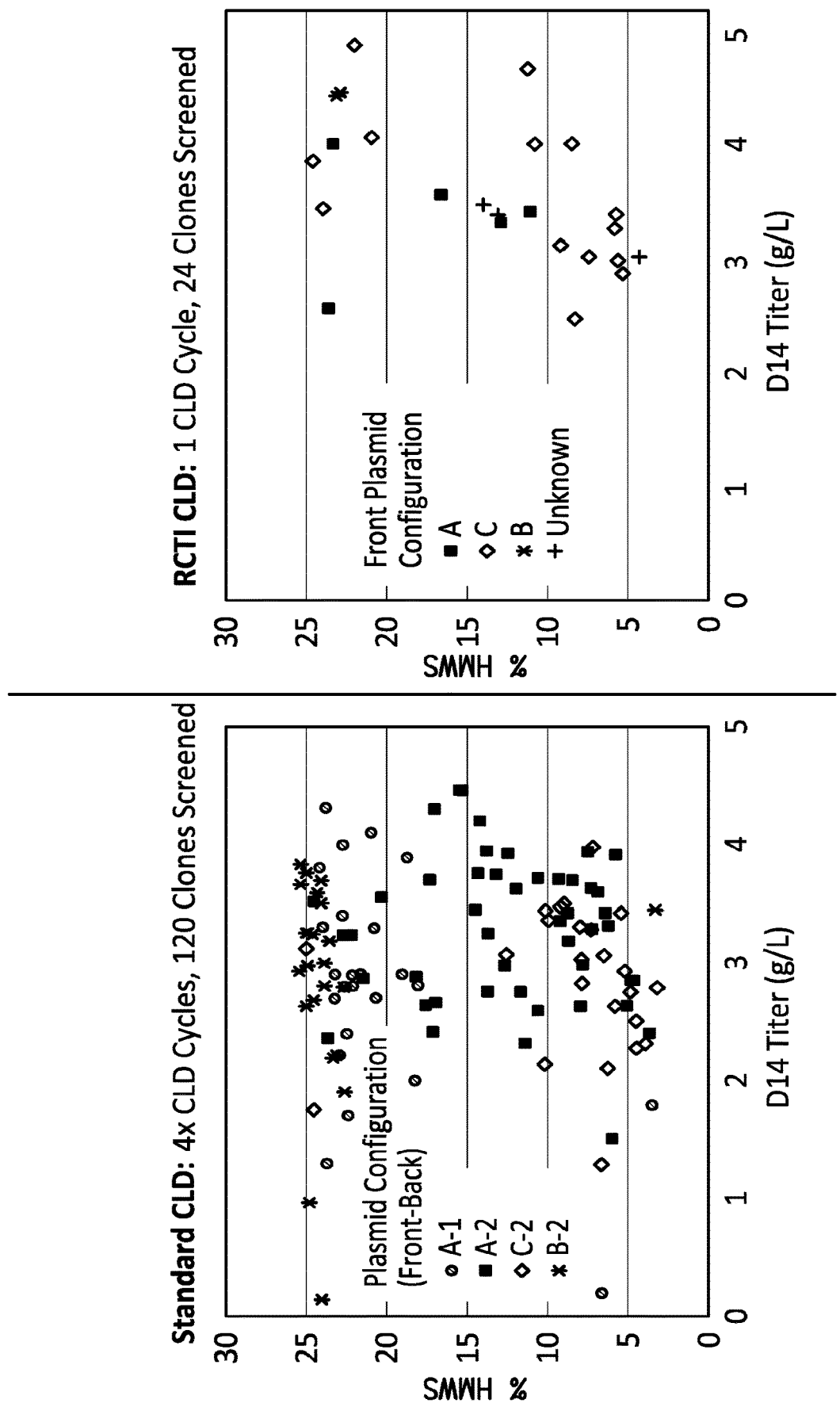
FIGS. 3A-3B depict the distribution of titer and % HMWS for clones evaluated in production culture as well as the identified configurations.

In certain embodiments, the host cells, genetic constructs (e.g., vectors), compositions, and methods described herein can be employed in the development and/or use of a "Randomized Configuration Targeted Integration" (also referred to herein as "randomized chain targeted integration") (RCTI) strategy for more efficient (e.g., less time and/or resource intensive) identification of host cells exhibiting expression levels, product quality attributes, and production culture performance comparable to conventional methodologies.

For purposes of clarity of disclosure and not by way of limitation, the detailed description is divided into the following subsections:
1. Definitions
2. Host Cell Preparation & Screening Strategies
3. Exogenous Nucleotide Sequences
4. Host Cells
5. Targeted Integration
6. Products 1. Definitions Unless otherwise defined, all technical and scientific terms used herein have the same meaning as commonly understood by one of ordinary skill in the art. In case of conflict, the present document, including definitions, will control. Preferred methods and materials are described below, although methods and materials similar or equivalent to those described herein can be used in practice or testing of the presently disclosed subject matter. All publications, patent applications, patents and other references mentioned herein are incorporated by reference in their entirety. The materials, methods, and examples disclosed herein are illustrative only and not intended to be limiting.

The terms "comprise(s)," "include(s)," "having," "has," "can," "contain(s)," and variants thereof, as used herein, are intended to be open-ended transitional phrases, terms, or words that do not preclude the possibility of additional acts or structures. The singular forms "a," "an" and "the" include plural references unless the context clearly dictates otherwise. The present disclosure also contemplates other embodiments "comprising," "consisting of", and "consisting essentially of," the embodiments or elements presented herein, whether explicitly set forth or not.

For the recitation of numeric ranges herein, each intervening number there between with the same degree of precision is explicitly contemplated. For example, for the range of 6-9, the numbers 7 and 8 are contemplated in addition to 6 and 9, and for the range 6.0-7.0, the number 6.0, 6.1, 6.2, 6.3, 6.4, 6.5, 6.6, 6.7, 6.8, 6.9, and 7.0 are explicitly contemplated.

As used herein, the term "about" or "approximately" means within an acceptable error range for the particular value as determined by one of ordinary skill in the art, which will depend in part on how the value is measured or determined, i.e., the limitations of the measurement system. For example, "about" can mean within 3 or more than 3 standard deviations, per the practice in the art. Alternatively, "about" can mean a range of up to 20%, preferably up to 10%, more preferably up to 5%, and more preferably still up to 1% of a given value. Alternatively, particularly with respect to biological systems or processes, the term can mean within an order of magnitude, preferably within 5-fold, and more preferably within 2-fold, of a value.

As used herein, the term "selection marker" can be a gene that allows cells carrying the gene to be specifically selected for or against, in the presence of a corresponding selection agent. For example, but not by way of limitation, a selection marker can allow the host cell transformed with the selection marker gene to be positively selected for in the presence of the gene; a non-transformed host cell would not be capable of growing or surviving under the selective conditions. Selection markers can be positive, negative or bi-functional. Positive selection markers can allow selection for cells carrying the marker, whereas negative selection markers can allow cells carrying the marker to be selectively eliminated. A selection marker can confer resistance to a drug or compensate for a metabolic or catabolic defect in the host cell. In prokaryotic cells, amongst others, genes conferring resistance against ampicillin, tetracycline, kanamycin or chloramphenicol can be used. Resistance genes useful as selection markers in eukaryotic cells include, but are not limited to, genes for aminoglycoside phosphotransferase (APH) (e.g., hygromycin phosphotransferase (HYG), neomycin and G418 APH), dihydrofolate reductase (DHFR), thymidine kinase (TK), glutamine synthetase (GS), asparagine synthetase, tryptophan synthetase (indole), histidinol dehydrogenase (histidinol D), and genes encoding resistance to puromycin, blasticidin, bleomycin, phleomycin, chloramphenicol, Zeocin, and mycophenolic acid. Further marker genes are described in WO 92/08796 and WO 94/28143.

Beyond facilitating a selection in the presence of a corresponding selection agent, a selection marker can alternatively provide a gene encoding a molecule normally not present in the cell, e.g., green fluorescent protein (GFP), enhanced GFP (eGFP), synthetic GFP, yellow fluorescent protein (YFP), enhanced YFP (eYFP), cyan fluorescent protein (CFP), mPlum, mCherry, tdTomato, mStrawberry, J-red, DsRed-monomer, mOrange, mKO, mCitrine, Venus, YPet, Emerald, CyPet, mCFPm, Cerulean, and T-Sapphire. Cells harboring such a gene can be distinguished from cells not harboring this gene, e.g., by the detection of the fluorescence emitted by the encoded polypeptide.

As used herein, the term "operably linked" refers to a juxtaposition of two or more components, wherein the components are in a relationship permitting them to function in their intended manner. For example, a promoter and/or an enhancer is operably linked to a coding sequence if the promoter and/or enhancer acts to modulate the transcription of the coding sequence. In certain embodiments, DNA sequences that are "operably linked" are contiguous and adjacent on a single chromosome. In certain embodiments, e.g., when it is necessary to join two protein encoding regions, such as a secretory leader and a polypeptide, the sequences are contiguous, adjacent, and in the same reading frame. In certain embodiments, an operably linked promoter is located upstream of the coding sequence and can be adjacent to it. In certain embodiments, e.g., with respect to enhancer sequences modulating the expression of a coding sequence, the two components can be operably linked although not adjacent. An enhancer is operably linked to a coding sequence if the enhancer increases transcription of the coding sequence. Operably linked enhancers can be located upstream, within, or downstream of coding sequences and can be located a considerable distance from the promoter of the coding sequence. Operable linkage can be accomplished by recombinant methods known in the art, e.g., using PCR methodology and/or by ligation at convenient restriction sites. If convenient restriction sites do not exist, then synthetic oligonucleotide adaptors or linkers can be used in accord with conventional practice. An internal ribosomal entry site (IRES) is operably linked to an open reading frame (ORF) if it allows initiation of translation of the ORF at an internal location in a 5' end-independent manner.

As used herein, the term "expression" refers to transcription and/or translation. In certain embodiments, the level of transcription of a desired product can be determined based on the amount of corresponding mRNA that is present. For example, mRNA transcribed from a sequence of interest can be quantitated by PCR or by Northern hybridization. In certain embodiments, protein encoded by a sequence of interest can be quantitated by various methods, e.g. by ELISA, by assaying for the biological activity of the protein, or by employing assays that are independent of such activity, such as Western blotting or radioimmunoassay, using antibodies that recognize and bind to the protein.

The term "sequence of interest" is used herein to refer to a polypeptide sequence (or, in certain instances, a nucleic acid encoding a polypeptide sequence), where expression of the polypeptide sequence is of interest. Such polypeptide sequences can, in certain embodiments, comprise a subunit of a multi-subunit protein complex. In certain embodiments, such polypeptide sequences can comprise fragments of such subunits. Such polypeptide sequences can, in certain embodiments, comprise an antibody sequence, e.g., an antibody heavy chain or light chain sequence. In certain embodiments, such polypeptide sequences can comprise fragments of such antibody sequences.

The term "antibody" is used herein in the broadest sense and encompasses various antibody structures, including but not limited to monoclonal antibodies, polyclonal antibodies, multispecific antibodies (e.g., bispecific antibodies), half antibodies, and antibody fragments so long as they exhibit a desired antigen-binding activity.

As used herein "standard antibodies" and "standard monoclonal antibodies" are antibodies or antibody fragments having a single binding specificity. In certain embodiments, the single binding specificity of standard antibodies is the result of the pairing of a heavy chain sequence, or fragment thereof, with a light chain sequence, or fragment thereof.

As used herein "Bispecific Antibodies" or "BsAbs" are antibodies that can simultaneously bind two distinct epitopes, e.g., two distinct epitopes on two distinct antigens or two distinct epitopes on a single antigen. BsAbs encompass numerous distinct structures, including those comprising paired variable heavy ($V_H$) and light ($V_L$) domains of two distinct parental monoclonal antibodies resulting in one "arm" (i.e., one paired $V_H$ and $V_L$) of the BsAb having the binding specificity of the first parental antibody and a second "arm" of the BsAb having the binding specificity of the second parental antibody. BsAbs are a subset of multispecific antibodies, where multispecific antibodies comprise at least two binding specificities (i.e., BsAbs), but also include trispecific antibodies as well as antibodies having higher numbers of specificities.

As used herein, the term "antibody fragment" refers to a molecule other than an intact antibody that comprises a portion of an intact antibody that binds the antigen to which the intact antibody binds. Examples of antibody fragments include but are not limited to Fv, Fab, Fab', Fab'-SH, F(ab')$_2$; diabodies; linear antibodies; single-chain antibody molecules (e.g., scFv); and multispecific antibodies formed from antibody fragments.

As used herein, the term "variable region" or "variable domain" refers to the domain of an antibody heavy or light chain that is involved in binding the antibody to antigen. The variable domains of the heavy chain and light chain ($V_H$ and $V_L$, respectively) of a native antibody generally have similar structures, with each domain comprising four conserved framework regions (FRs) and three hypervariable regions (HVRs). See, e.g., Kindt et al. Kuby Immunology, 6th ed., W.H. Freeman and Co., page 91 (2007). A single $V_H$ or $V_L$ domain may be sufficient to confer antigen-binding specificity. Furthermore, antibodies that bind to a particular antigen may be isolated using a $V_H$ or $V_L$ domain from an antibody that binds the antigen to screen a library of complementary $V_L$ or $V_H$ domains, respectively. See, e.g., Portolano et al., J. Immunol. 150: 880-887 (1993); Clarkson et al., Nature 352:624-628 (1991).

As used herein, the term "vector" refers to a nucleic acid molecule capable of propagating another nucleic acid to which it is linked. The term includes the vector as a self-replicating nucleic acid structure as well as the vector incorporated into the genome of a host cell into which it has been introduced. In certain embodiments, vectors direct the expression of nucleic acids to which they are operatively linked. Such vectors are referred to herein as "expression vectors."

As used herein, the term "homologous sequences" refers to sequences that share a significant sequence similarity as determined by an alignment of the sequences. For example, two sequences can be about 50%, 60%, 70%, 80%, 90%, 95%, 99%, or 99.9% homologous. The alignment is carried out by algorithms and computer programs including, but not limited to, BLAST, FASTA, and HMME, which compares sequences and calculates the statistical significance of matches based on factors such as sequence length, sequence identify and similarity, and the presence and length of sequence mismatches and gaps. Homologous sequences can refer to both DNA and protein sequences.

As used herein, the term "flanking" refers to that a first nucleotide sequence is located at either a 5' or 3' end, or both ends of a second nucleotide sequence. The flanking nucleotide sequence can be adjacent to or at a defined distance from the second nucleotide sequence. There is no specific limit of the length of a flanking nucleotide sequence. For example, a flanking sequence can be a few base pairs or a few thousand base pairs.

As used herein, the term "exogenous" indicates that a nucleotide sequence does not originate from a host cell and is introduced into a host cell by traditional DNA delivery methods, e.g., by transfection, electroporation, or transformation methods. The term "endogenous" refers to that a nucleotide sequence originates from a host cell. An "exogenous" nucleotide sequence can have an "endogenous" counterpart that is identical in base compositions, but where the "exogenous" sequence is introduced into the host cell, e.g., via recombinant DNA technology.

As used herein, an "integration site" comprises a nucleic acid sequence within a host cell genome into which an exogenous nucleotide sequence is inserted. In certain embodiments, an integration site is between two adjacent nucleotides on the host cell genome. In certain embodiments, an integration site includes a stretch of nucleotide sequences. In certain embodiments, the integration site is located within a specific locus of the genome of the TI host cell. In certain embodiments, the integration site is within an endogenous gene of the TI host cell.

As used herein, the term "TI host cell" refers to a cell comprising a genomic locus or loci, i.e., integration site(s), for use in expressing a sequence of interest. In certain embodiments, integration of SOIs into the TI host cell is facilitated by the presence of an exogenous nucleotide sequence at one more integration sites comprising two or more RRSs. In certain embodiments, integration of SOIs into the TI host cell is facilitated by a genome editing system capable of editing the TI host cell genome at one or more integration sites.

2. Host Cell Preparation & Screening Strategies

Standard CLD strategies generally involve multiple rounds of host cell transfection by one or more specific exogenous nucleic acids encoding a sequence (or sequences) of interest. As illustrated in FIG. 1A, the preparation of such exogenous nucleic acids, e.g., plasmids comprising antibody heavy and light chain coding sequences, is followed by transfection, e.g., via recombinase mediated cassette exchange "RMCE" in the context of targeted integration. Regardless of the integration strategy (e.g., either random or targeted integration), pools of transfected host cells are then allowed to recover prior to selection and single cell cloning (SCC). Multiple rounds of clonal analysis, e.g., via homogenous time resolved fluorescence ("HTRF") titer assays, are then employed to narrow the number of clones for more detailed productivity and product quality assays, e.g., high molecular weight species content ("% HMWS"), size variation, acidic variation, and glycosylation variation.

FIG. 2A illustrates a standard targeted integration-based CLD strategy, where multiple CLD cycles are employed to identify cells exhibiting desirable expression levels, product quality attributes, and production culture performance. In this example, each pool of transfected cells is prepared by contacting a plurality of host cells with a particular combination of two exogenous nucleic acids encoding sequences of interest. While FIG. 2A illustrates a strategy involving the targeted integration of sequences of interest from a first "front" plasmid and a second "back" plasmid into particular locus in the host genome (see Section 5.1, below, for a general description of two-vector RCME strategy), it is to be appreciated that targeted integration approaches can involve integration of a single sequence of interest or more than two sequences of interest. Moreover, targeted integration strategies can, as outlined herein, employ not only recombinase-mediated integration of SOIs as illustrated in FIGS. 2A and 2B, but also other locus-specific strategies for integration of a SOI, e.g., gene editing-mediated integration of SOIs. As noted above, however, a defining feature of targeted integration approaches is that they are designed to result in the integration of specific sequences in specific arrangements, i.e., a fixed configuration of transgenes, within the genome. In light of this design feature, it is necessary, as outlined in FIG. 2A, to perform multiple cycles of CLD to ensure a sufficient number of variations in sequence of interest copy number and arrangement are assayed.

In contrast to the standard resource-intensive multi-cycle targeted integration CLD strategy illustrated in FIG. 2A, the subject matter of the instant application relates to a "Randomized Configuration Targeted Integration" (also referred to herein as "randomized chain targeted integration") (RCTI) strategy, which allows for single-cycle assaying of variations in sequence of interest copy number and arrangement, yet retains the locus-specific integration benefits of targeted integration. As outlined in FIG. 2B, all of the relevant exogenous nucleic acids encoding sequences of interest can be evaluated via the production of a single transfection pool. By combining the full complement of relevant exogenous nucleic acids encoding sequences of interest with a plurality of host cells, a single transfection pool is created from which clones exhibiting desirable expression levels, product quality attributes, and production culture performance can be identified.

While exemplary FIG. 2B illustrates an embodiment employing three "front" and three "back" plasmids (each comprising one or more sequences of interest) to be integrated into the front or back cassettes of an exogenous nucleotide sequence present at a specific locus in the host cell genome (See Section 5.1, below, for a full description of such "two vector RMCE" strategies), it is to be appreciated that the subject matter of the instant disclosure encompasses a wide variety of variations on such targeted integration strategies. For example, rather than using a first plasmid comprising a front cassette and a second plasmid comprising a back cassette, the present disclosure also encompasses methods involving single cassette integration. In addition, the present disclosure also encompasses methods involving the integration of three, four, five, six, seven, eight, nine, ten, or more cassettes into a single exogenous nucleotide sequence present at a specific locus in a host cell genome. Moreover, not only can each cassette comprise one, two, three, four, five, six, seven, eight, nine, ten, or more individual sequences of interest, but each host genome can comprise one, two, three, four, five, six, seven, eight, nine, ten, or more exogeneous nucleotide sequence present at specified loci in a host cell genome into which the cassettes comprising the sequences of interest can be integrated. Accordingly, while exemplary FIG. 2B illustrates a strategy whereby three front cassettes and three back cassettes can be used to generate nine possible sequence of interest transgene configurations, the present disclosure encompasses strategies for generating both fewer and more transgene configurations, including at more than one locus in the host genome.

Figure 5:
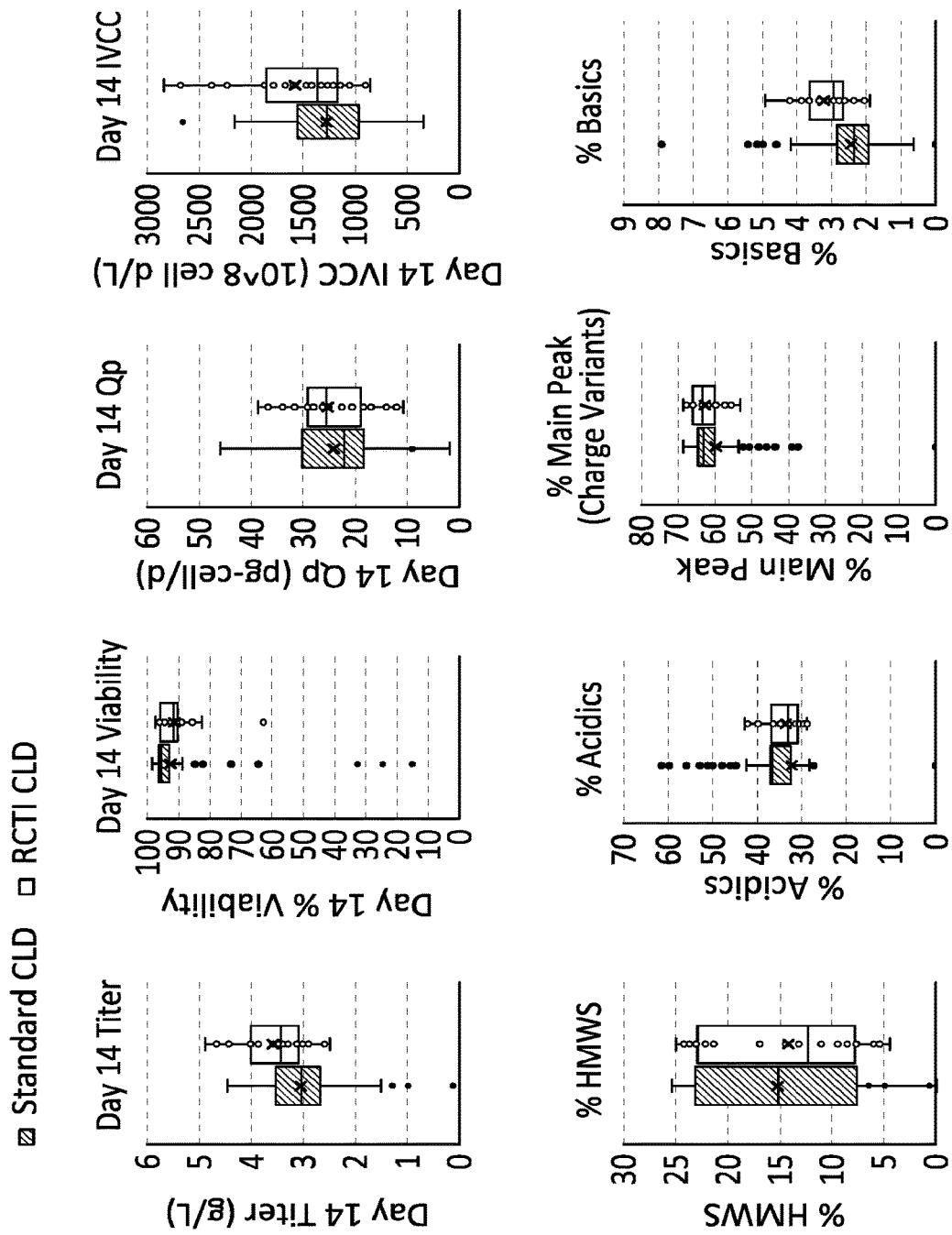
FIG. 5 depicts product quality attributes comparable between standard CLD and RCTI approaches.
Figure 5:
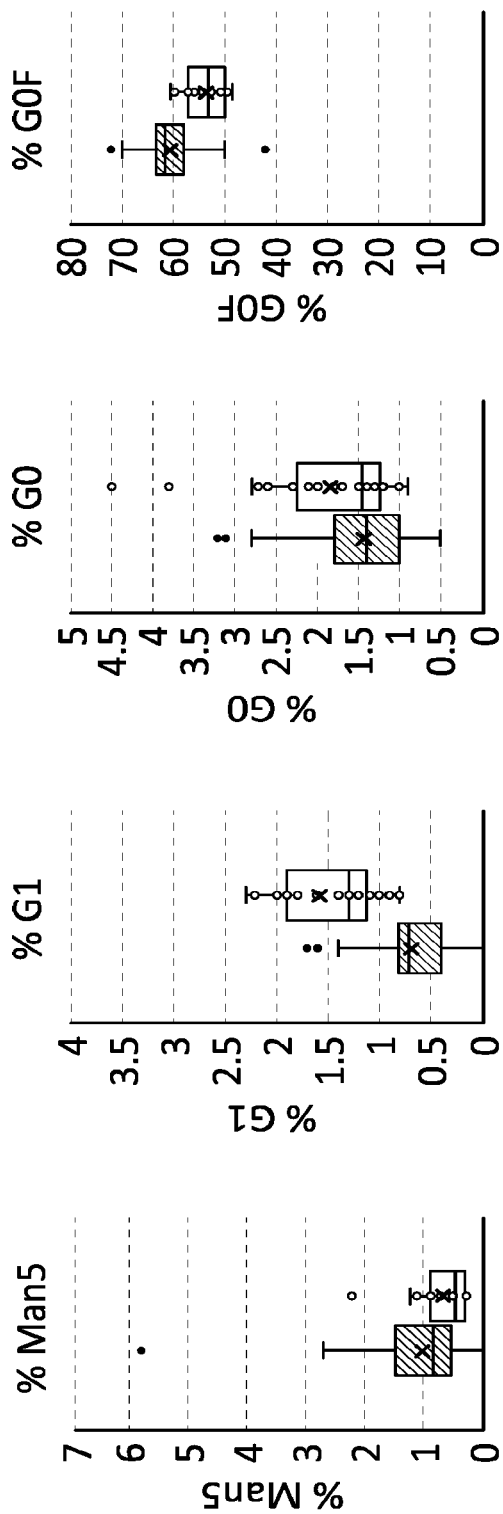

Employing the RCTI strategies outlined herein can result in significant conservation of resources, including, but not limited to, cost and time savings, labor savings, as well as the alleviation of automation bottlenecks. As illustrated in FIGS. 3-5, such conservation of resources does not adversely impact the distribution of desirable expression levels, product quality attributes, or production culture performance observed as compared to standard CLD strategies.

RCTI approaches also allow for, as illustrated in FIGS. 6A-6C, single cell cloning at Early, Mid, or Full recovery stages. Because standard CLD strategies generally involve waiting for full transfection pool recovery (e.g., >90% cell viability) prior to engaging in single cell cloning, employment of an RCTI strategy can result in significant time savings without affecting clone performance (% of clones with high titer and desired product quality) or heterogeneity (range of vector configurations, titer, and product quality).

In certain embodiments, the present disclosure is directed to a high throughput RCTI-based method of screening a library of TI host cells expressing at least one SOI. In certain embodiments, the method comprises the generation of a library of TI host cells, wherein said library comprises a plurality of TI host cells expressing one or more SOIs, by: separating the library into single clones and screening the clones for a specific cellular and/or a specific product attribute. In certain embodiments, the generation of the library of TI host cells comprises the steps of providing a plurality of TI host cells, contacting the plurality of TI host cells with a plurality of vectors, wherein the vectors comprise one or more SOIs, and introducing the one or more SOIs into one or more of the plurality of TI host cells.

In certain embodiments, the sequences of interest can be introduced into the host cells of the present disclosure by recombinase-mediated integration. In certain embodiments, the sequences of interest can be introduced into the host cells of the present disclosure by gene editing-mediated integration.

In certain embodiments, the screening methods of the present disclosure can include the screening of the cells for cellular attributes that can be any of, but not limited to, cell growth, cell titer, specific productivity, volumetric productivity, clone stability. Screening for these cellular attributes can be performed with any technique known in the art.

In certain embodiments, the screening methods of the present disclosure can include the screening of the cells for the product attribute that can be any of, but not limited to, level of glycosylation, level of charge variance, reduced mismatch, reduced protein/peptide aggregation, protein sequence heterogeneity. Screening for these product attributes can be performed with any technique known in the art such as, but not limited to, size exclusion chromatography (SEC), cDNA sequencing, peptide mapping, CE-SDS or SDS-PAGE, HPLC, CE based glycan assays, IEF, and ion exchange chromatography.

In certain embodiments, the present disclosure provides a RCTI-based method of generating a library of TI host cells comprising a plurality of exogenous nucleotide SOIs comprising contacting a plurality of TI host cells with vectors having one or more SOIs, introducing the one or more SOIs into the TI host cells and selecting the TI cells expressing the one or more SOIs. In certain embodiments, the TI host cells generated by methods of the present disclosure will comprise one or more exogenous nucleotide sequences integrated at one or more loci of the genome of the TI host cell. In certain embodiments, the exogenous nucleotide sequence can comprise at least two RRSs that can be flanking one or more selection markers.

In certain embodiments, the vector can contain one or more selectable marker genes to provide a phenotypic trait for selection of transformed host cells such as dihydrofolate reductase or neomycin resistance for eukaryotic cell culture. In certain embodiments, the host cell can be a higher eukaryotic cell, such as a mammalian cell, or a lower eukaryotic cell, such as a yeast cell, or the host cell can be a prokaryotic cell, such as a bacterial cell. In certain embodiments, the library may be screened for a specific sequence of interest, such as but not limited to, a polypeptide sequence. In certain embodiments, resultant libraries of can be screened for clones which display activity for a polypeptide of interest in a phenotypic assay. In certain embodiments, the library can be screened for a specified protein, e.g. enzyme, activity by procedures known in the art In certain embodiments, the present disclosure is directed to an RCTI-based method of selecting a host cell expressing a sequence of interest comprising: providing a plurality of TI host cells; contacting the plurality of TI host cells with a plurality of vectors, wherein the vectors comprise one or more SOIs and at least one marker; introducing the one or more SOIs into one or more of the plurality of TI host cells; and selecting for TI host cells expressing the selection marker to thereby isolate a TI host cell expressing the sequence of interest. In certain embodiments, the SOI can encode a polypeptide subunit, or fragment thereof, of a multisubunit protein. In certain embodiments, the SOI can encode a single chain antibody, an antibody light chain, an antibody heavy chain, a single-chain Fv fragment (scFv), or an Fc fusion protein. In certain embodiments, the locus into which the exogenous nucleotide sequence is integrated and is at least about 50%, at least about 60%, at least about 70%, at least about 80%, at least about 90%, at least about 95%, at least about 99%, or at least about 99.9% homologous to a sequence selected from SEQ ID Nos. 1-7.

In certain embodiments, the one or more exogenous nucleotide sequences can be integrated at one or more loci having at least about 50%, at least about 60%, at least about 70%, at least about 80%, at least about 90% at least about 95%, at least about 99%, or at least about 99.9% homology to a sequence selected from: SEQ ID Nos. 1-12; NW_006874047.1; NW_006884592.1; NW_006881296.1; NW_003616412.1; NW_003615063.1; NW_006882936.1; and NW_003615411.1.

In certain embodiments, the locus into which the exogenous nucleotide sequence is integrated is at least about 50%, at least about 60%, at least about 70%, at least about 80%, at least about 90%, at least about 95%, at least about 99%, or at least about 99.9% homologous to a sequence selected from the sequences SEQ ID NOs: 1-4 of U.S. Pat. No. 9,816,110, corresponding to SEQ ID NOs: 8-11 of the present disclosure, or SEQ ID NO: 1 of the International Application No. PCT/US2017/028555, corresponding to SEQ ID NO: 12 of the present disclosure. In certain embodiments, the one or more sequences of interest can be introduced into the host cells of the present disclosure by recombinase-mediated integration. In certain embodiments, the one or more sequences of interest can be introduced into the host cells of the present disclosure by gene editing-mediated integration.

In certain embodiments the TI host cells used in the RCTI-based method of selecting a host cell expressing a sequence of interest described in the present disclosure can each have one or more exogenous nucleotide sequences integrated at one or more loci of the genome of the TI host cell. In certain embodiments, the exogenous nucleotide sequence can comprise at least two RRSs, flanking at least one first selection marker. In certain embodiments, the vectors used in the RCTI-based method of selecting a host cell can comprise at least two RRSs matching the at least two RRS on the integrated exogenous nucleotide sequence and one or more exogenous SOI and at least one second selection marker flanked by these RRSs. In certain embodiments, the exogenous nucleotide sequence can comprise a first and a second RRS flanking at least one first selection marker, and a third RRS located between the first and the second RRS, and all the RRSs can be heterospecific. In certain embodiments the plurality of vectors can comprise a first and a second vector. In certain embodiments, the first vector can comprise two RRSs matching the first and the third RRS on the integrated exogenous nucleotide sequence and flanking at least one first exogenous SOI and at least one second selection marker; and the second vector can comprise two RRSs matching the second and the third RRS on the integrated exogenous nucleotide sequence and flanking at least one second exogenous SOI. In certain embodiments, the plurality of vectors can comprise 1, 2, 3, 4, 5, 6, 7, 8, 9, 10 or more vectors.

In certain embodiments the sequence of interest comprises the sequence of one or more subunits of a multi-subunit protein complex. In certain embodiments, such polypeptide sequences can comprise fragments of such subunit sequences. In certain embodiments, the sequences of interest can comprise combinations of such subunit sequences. For example, but not by way of limitation, such combinations can comprise one, two, three, four, five, six, seven, eight, nine, ten, or more of a first subunit sequence and/or one, two, three, four, five, six, seven, eight, nine, ten, or more sequences of a second, third, fourth, fifth, sixth, seventh, eighth, ninth, tenth, or more subunit sequence. Moreover, in certain embodiments, such combinations can comprise one, two, three, four, five, six, seven, eight, nine, ten, or more distinct variations of a first subunit sequence and/or one, two, three, four, five, six, seven, eight, nine, ten, or more distinct variations of a second, third, fourth, fifth, sixth, seventh, eighth, ninth, tenth, or more subunit sequence.

In certain embodiments, the plurality of sequences of interest comprise one or more antibody heavy chain sequences ("H") and/or one or more antibody light chain sequences ("L"). As used herein, such "H" and "L" sequences can be full length heavy or light chain sequences as well as heavy or light chain fragments, including, but not limited to, variable region fragments and complementary determining region fragments. In certain embodiments, the sequences of interest can comprise combinations of such H and L sequences. For example, but not by way of limitation, such combinations can comprise one, two, three, four, five, six, seven, eight, nine, ten, or more H sequences and/or one, two, three, four, five, six, seven, eight, nine, ten, or more L sequences. Moreover, in certain embodiments, such combinations can comprise one, two, three, four, five, six, seven, eight, nine, ten, or more of the same or different distinct H' sequences and/or one, two, three, four, five, six, seven, eight, nine, ten, or more of the same or different distinct L' sequences. The inclusion of one to ten (or more) additional H and L sequences, e.g., H", H"', L", and L"', are also encompassed by the presently disclosed subject matter. Exemplary embodiments include, but are not limited, to sequences comprising any combination of various distinct H and various distinct L sequence such as: HL; LH; H'L; LH'; H'L'; L'H'; HLL; HHL; LLH; LHH; H'LL; H'HL; L'HH; L'LH; H'H'L; LH'H'; HLLL; LLLH; HLHL; LHLH; H'LLL; L'LLH; H'LHL; L'HLH; etc.

In certain embodiments, the present disclosure is directed to a method of expressing a SOT, comprising: providing a plurality of TI host cells; contacting the plurality of TI host cells with a plurality of vectors comprising one or more SOIs and at least one marker; introducing the one or more SOIs into one or more of the plurality of the TI host cells; selecting for TI cells expressing the sequence of interest; and culturing the cell under conditions suitable for expressing the sequence of interest and recovering the sequence of interest therefrom.

In certain embodiments the transfected host cell will comprise one or more sequence of interest where the sequence of interest comprises the sequence of one or more subunits of a multi-subunit protein complex. In certain embodiments, such polypeptide sequences can comprise fragments of such subunit sequences. In certain embodiments, the sequences of interest can comprise combinations of such subunit sequences. For example, but not by way of limitation, such combinations can comprise one, two, three, four, five, six, seven, eight, nine, ten, or more of a first subunit sequence and/or one, two, three, four, five, six, seven, eight, nine, ten, or more sequences of a second, third, fourth, fifth, sixth, seventh, eighth, ninth, tenth, or more subunit sequence. Moreover, in certain embodiments, such combinations can comprise one, two, three, four, five, six, seven, eight, nine, ten, or more of the same or different distinct variations of a first subunit sequence and/or one, two, three, four, five, six, seven, eight, nine, ten, or more of the same or different distinct variations of a second, third, fourth, fifth, sixth, seventh, eighth, ninth, tenth, or more subunit sequence.

In certain embodiments the transfected host cell will comprise one or more sequence of interest where the sequences of interest can comprise combinations of H and L sequences. For example, but not by way of limitation, such combinations can comprise one, two, three, four, five, six, seven, eight, nine, ten, or more H sequences and/or one, two, three, four, five, six, seven, eight, nine, ten, or more L sequences. Moreover, in certain embodiments, such combinations can comprise one, two, three, four, five, six, seven, eight, nine, ten, or more distinct H' sequences and/or one, two, three, four, five, six, seven, eight, nine, ten, or more distinct L' sequences. The inclusion of one to ten (or more) additional H and L sequences, e.g., H", H"', L", and L"', are also encompassed by the presently disclosed subject matter. Exemplary embodiments include, but are not limited, to sequences comprising any combination of various distinct H and various distinct L sequence such as: HL; LH; H'L; LH'; H'L'; L'H'; HLL; HHL; LLH; LHH; H'LL; H'HL; L'HH; L'LH; H'H'L; LH'H'; HLLL; LLLH; HLHL; LHLH; H'LLL; L'LLH; H'LHL; L'HLH; etc.

3. Exogenous Nucleotide Sequences

The presently disclosed subject matter provides host cells suitable for the integration of exogenous nucleotides sequences. In certain embodiments, the exogenous nucleotide sequences serve as integration sites, e.g., by comprising one or more recombinase recognition sequences. In certain embodiments an exogenous nucleotide sequences codes for a sequence of interest. Accordingly, in certain embodiments, a host cell will comprise one or more exogenous nucleotide sequences that will facilitate the targeted integration of one or more exogenous nucleotide sequences coding for one or more sequences of interest. In certain embodiments, a host cell comprising an exogenous nucleotide sequence integrated at an integration site on the genome of the host cell is referred to as a TI host cell. Exogenous nucleotide sequences coding for one or more sequences of interest can be then introduced into the TI host cell and integration can be targeted to the integration site. As outlined below, a TI host cell may comprise multiple integration sites defined by the presence of an exogenous nucleotide sequence comprising elements, e.g., recombinase recognition sequences, that facilitate the integration of an exogenous nucleotide sequence coding for one or more sequences of interest.

In certain embodiments, an integration site and/or the nucleotide sequences flanking the integration site can be identified experimentally. In certain embodiments, an integration site and/or the nucleotide sequences flanking the integration site can be identified by genome-wide screening approaches to isolate host cells that express, at a desirable level, a polypeptide of interest encoded by one or more SOIs integrated into one or more exogenous nucleotide sequences, where the exogenous sequences are themselves integrated into one or more loci in the genome of the host cell. In certain embodiments, an integration site and/or the nucleotide sequences flanking an integration site can be identified by genome-wide screening approaches following transposase-based cassette integration event. In certain embodiments, an integration site and/or the nucleotide sequences flanking an integration site can be identified by brute force random integration screening. In certain embodiments, an integration site and/or the nucleotide sequences flanking an integration site can be determined by conventional sequencing approaches such as target locus amplification (TLA) followed by next-generation sequencing (NGS) and whole-genome NGS. In certain embodiments, the location of an integration site on a chromosome can be determined by conventional cell biology approaches such as fluorescence in-situ hybridization (FISH) analysis.

In certain embodiments, a host cell comprises a first exogenous nucleotide sequence integrated at a first integration site within a specific first locus in the genome of the host cell and a second exogenous nucleotide sequence integrated at a second integration site within a specific second locus in the genome. In certain embodiments, a host cell comprises multiple exogenous nucleotide sequences integrated at multiple integration sites in the genome of the host cell.

3.1 Exogenous Sequence Comprising a Recombinase Recognition Sequence

In certain embodiments, an integrated exogenous nucleotide sequence comprises one or more recombinase recognition sequence (RRS), wherein the RRS can be recognized by a recombinase. In certain embodiments, the integrated exogenous nucleotide sequence comprises at least two RRSs. In certain embodiments, the integrated exogenous nucleotide sequence comprises two RRSs and the two RRSs are the same. In certain embodiments, the integrated exogenous nucleotide sequence comprises two RRSs and the two RRSs are different. In certain embodiments, an integrated exogenous nucleotide sequence comprises three RRSs, wherein the third RRS is located between the first and the second RRS. In certain embodiments, the first and the second RRS are the same and the third RRS is different from the first or the second RRS. In certain embodiments, all three RRSs are different. In certain embodiments, an integrated exogenous nucleotide sequence comprises four, five, six, seven, or eight RRSs. In certain embodiments, an integrated exogenous nucleotide sequence comprises multiple RRSs. In certain embodiments, the multiple two or more RRSs are the same. In certain embodiments, the two or more RRSs are different. In certain embodiments, the subset of the total number of RRSs are the same and a subset of the total number of RRSs are different. In certain embodiments, the RRS or RRSs can be selected from the group consisting of a LoxP sequence, a LoxP L3 sequence, a LoxP 2L sequence, a LoxFas sequence, a Lox511 sequence, a Lox2272 sequence, a Lox2372 sequence, a Lox5171 sequence, a Loxm2 sequence, a Lox71 sequence, a Lox66 sequence, a FRT sequence, a Bxb1 attP sequence, a Bxb1 attB sequence, a φC31 attP sequence, and a φC31 attB sequence.

In certain embodiments, the integrated exogenous nucleotide sequence comprises at least one selection marker. In certain embodiments, the integrated exogenous nucleotide sequence comprises one RRS and at least one selection marker. In certain embodiments, the integrated exogenous nucleotide sequence comprises a first and a second RRS, and at least one selection marker. In certain embodiments, a selection marker is located between the first and the second RRS. In certain embodiments, two RRSs flank at least one selection marker, i.e., a first RRS is located 5' upstream and a second RRS is located 3' downstream of the selection marker. In certain embodiments, a first RRS is adjacent to the 5' end of the selection marker and a second RRS is adjacent to the 3' end of the selection marker.

In certain embodiments, a selection marker is located between a first and a second RRS and the two flanking RRSs are the same. In certain embodiments, the two RRSs flanking the selection marker are both LoxP sequences. In certain embodiments, the two RRSs flanking the selection marker are both FRT sequences. In certain embodiments, a selection marker is located between a first and a second RRS and the two flanking RRSs are different. In certain embodiments, the first flanking RRS is a LoxP L3 sequence and the second flanking RRS is a LoxP 2L sequence. In certain embodiments, a LoxP L3 sequence is located 5' of the selection marker and a LoxP 2L sequence is located 3' of the selection marker. In certain embodiments, the first flanking RRS is a wild-type FRT sequence and the second flanking RRS is a mutant FRT sequence. In certain embodiments, the first flanking RRS is a Bxb1 attP sequence and the second flanking RRS is a Bxb1 attB sequence. In certain embodiments, the first flanking RRS is a φC31 attP sequence and the second flanking RRS is a φC31 attB sequence. In certain embodiments, the two RRSs are positioned in the same orientation. In certain embodiments, the two RRSs are both in the forward or reverse orientation. In certain embodiments, the two RRSs are positioned in opposite orientation.

In certain embodiments, a selection marker can be an aminoglycoside phosphotransferase (APH) (e.g., hygromycin phosphotransferase (HYG), neomycin and G418 APH), dihydrofolate reductase (DHFR), thymidine kinase (TK), glutamine synthetase (GS), asparagine synthetase, tryptophan synthetase (indole), histidinol dehydrogenase (histidinol D), and genes encoding resistance to puromycin, blasticidin, bleomycin, phleomycin, chloramphenicol, Zeocin, or mycophenolic acid. In certain embodiments, a selection marker can be a GFP, an eGFP, a synthetic GFP, a YFP, an eYFP, a CFP, an mPlum, an mCherry, a tdTomato, an mStrawberry, a J-red, a DsRed-monomer, an mOrange, an mKO, an mCitrine, a Venus, a YPet, an Emerald, a CyPet, an mCFPm, a Cerulean, or a T-Sapphire marker.

In certain embodiments, the integrated exogenous nucleotide sequence comprises two selection markers flanked by two RRSs, wherein a first selection marker is different from a second selection marker. In certain embodiments, the two selection markers are both selected from the group consisting of a glutamine synthetase selection marker, a thymidine kinase selection marker, a HYG selection marker, and a puromycin resistance selection marker. In certain embodiments, the integrated exogenous nucleotide sequence comprises a thymidine kinase selection marker and a HYG selection marker. In certain embodiments, the first selection maker is selected from the group consisting of an aminoglycoside phosphotransferase (APH) (e.g., hygromycin phosphotransferase (HYG), neomycin and G418 APH), dihydrofolate reductase (DHFR), thymidine kinase (TK), glutamine synthetase (GS), asparagine synthetase, tryptophan synthetase (indole), histidinol dehydrogenase (histidinol D), and genes encoding resistance to puromycin, blasticidin, bleomycin, phleomycin, chloramphenicol, Zeocin, and mycophenolic acid, and the second selection maker is selected from the group consisting of a GFP, an eGFP, a synthetic GFP, a YFP, an eYFP, a CFP, an mPlum, an mCherry, a tdTomato, an mStrawberry, a J-red, a DsRed-monomer, an mOrange, an mKO, an mCitrine, a Venus, a YPet, an Emerald, a CyPet, an mCFPm, a Cerulean, and a T-Sapphire marker. In certain embodiments, the first selection marker is a glutamine synthetase selection marker and the second selection marker is a GFP marker. In certain embodiments, the two RRSs flanking both selection markers are the same. In certain embodiments, the two RRSs flanking both selection markers are different.

In certain embodiments, the selection marker is operably linked to a promoter sequence. In certain embodiments, the selection marker is operably linked to an SV40 promoter. In certain embodiments, the selection marker is operably linked to a Cytomegalovirus (CMV) promoter.

In certain embodiments, the integrated exogenous nucleotide sequence comprises at least one selection marker and an IRES, wherein the IRES is operably linked to the selection marker. In certain embodiments, the selection marker operably linked to the IRES is selected from the group consisting of a GFP, an eGFP, a synthetic GFP, a YFP, an eYFP, a CFP, an mPlum, an mCherry, a tdTomato, an mStrawberry, a J-red, a DsRed-monomer, an mOrange, an mKO, an mCitrine, a Venus, a YPet, an Emerald, a CyPet, an mCFPm, a Cerulean, and a T-Sapphire marker. In certain embodiments, the selection marker operably linked to the IRES is a GFP marker. In certain embodiments, the integrated exogenous nucleotide sequence comprises an IRES and two selection markers flanked by two RRSs, wherein the IRES is operably linked to the second selection marker. In certain embodiments, the integrated exogenous nucleotide sequence comprises an IRES and three selection markers flanked by two RRSs, wherein the IRES is operably linked to the third selection marker. In certain embodiments, the integrated exogenous nucleotide sequence comprises an IRES and three selection markers flanked by two RRSs, wherein the IRES is operably linked to the third selection marker. In certain embodiments, the third selection marker is different from the first or the second selection marker. In certain embodiments, the integrated exogenous nucleotide sequence comprises a first selection marker operably linked to a promoter and a second selection marker operably linked to an IRES. In certain embodiments, the integrated exogenous nucleotide sequence comprises a glutamine synthetase selection marker operably linked to a SV40 promoter and a GFP selection marker operably linked to an IRES. In certain embodiments, the integrated exogenous nucleotide sequence comprises a thymidine kinase selection marker and a HYG selection marker operably linked to a CMV promoter and a GFP selection marker operably linked to an IRES.

In certain embodiments, the integrated exogenous nucleotide sequence comprises three RRSs. In certain embodiments, the third RRS is located between the first and the second RRS. In certain embodiments, all three RRSs are the same. In certain embodiments, the first and the second RRS are the same, and the third RRS is different from the first or the second RRS. In certain embodiments, all three RRSs are different.

In certain embodiments the exogenous nucleotide sequence serving as an integration site will be present at a site within a specific locus of the genome of a TI host cell. In certain embodiments, the locus into which the exogenous nucleotide sequence is integrated is at least about 50%, at least about 60%, at least about 70%, at least about 80%, at least about 90%, at least about 95%, at least about 99%, or at least about 99.9% homologous to a sequence selected from SEQ ID Nos. 1-7. In certain embodiments, the locus into which the exogenous nucleotide sequence is integrated is at least about 50%, at least about 60%, at least about 70%, at least about 80%, at least about 90%, at least about 95%, at least about 99%, or at least about 99.9% homologous to a sequence selected from the sequences SEQ ID NOs: 1-4 of U.S. Pat. No. 9,816,110, corresponding to SEQ ID NOs: 8-11 of the present disclosure, or SEQ ID NO: 1 of the International Application No. PCT/US2017/028555, corresponding to SEQ ID NO: 12 of the present disclosure.

In certain embodiments, the exogenous nucleotide sequence is integrated at a site within a specific locus of the genome of a TI host cell. In certain embodiments, the locus into which the exogenous nucleotide sequence is integrated is at least about 50%, at least about 60%, at least about 70%, at least about 80%, at least about 90%, at least about 95%, at least about 99%, or at least about 99.9% homologous to a sequence selected from Contigs NW_006874047.1, NW_006884592.1, NW_006881296.1, NW_003616412.1, NW_003615063.1, NW_006882936.1, and NW_003615411.1.

In certain embodiments, the exogenous nucleotide sequence is integrated at an integration site located within a position selected from nucleotides numbered 1-1,000 bp; 1,000-2,000 bp; 2,000-3,000 bp; 3,000-4,000 bp; and 4,000-4,301 bp of SEQ ID No. 1. In certain embodiments, the exogenous nucleotide sequence is integrated at an integration site located within a position selected from nucleotides numbered 1-100,000 bp; 100,000-200,000 bp; 200,000-300,000 bp; 300,000-400,000 bp; 400,000-500,000 bp; 500,000-600,000 bp; 600,000-700,000 bp; and 700,000-728785 bp of SEQ ID No. 2. In certain embodiments, the exogenous nucleotide sequence is integrated at an integration site located within a position selected from nucleotides numbered 1-100,000 bp; 100,000-200,000 bp; 200,000-300,000 bp; 300,000-400,000 bp; and 400,000-413,983 of SEQ ID No. 3. In certain embodiments, the exogenous nucleotide sequence is integrated at an integration site located within a position selected from nucleotides numbered 1-10,000 bp; 10,000-20,000 bp; 20,000-30,000 bp; and 30,000-30,757 bp of SEQ ID No. 4. In certain embodiments, the exogenous nucleotide sequence is integrated at an integration site located within a position selected from nucleotides numbered 1-10,000 bp; 10,000-20,000 bp; 20,000-30,000 bp; 30,000-40,000 bp; 40,000-50,000 bp; 50,000-60,000 bp; and 60,000-68,962 bp of SEQ ID No. 5. In certain embodiments, the exogenous nucleotide sequence is integrated at an integration site located within a position selected from nucleotides numbered 1-10,000 bp; 10,000-20,000 bp; 20,000-30,000 bp; 30,000-40,000 bp; 40,000-50,000 bp; and 50,000-51,326 bp of SEQ ID No. 6. In certain embodiments, the exogenous nucleotide sequence is integrated at an integration site located within a position selected from nucleotides numbered 1-10,000 bp; 10,000-20,000 bp; and 20,000-22,904 bp of SEQ ID No. 7.

In certain embodiments, the nucleotide sequence immediately 5' of the integrated exogenous sequence is selected from the group consisting of nucleotides 41190-45269 of NW_006874047.1, nucleotides 63590-207911 of NW_006884592.1, nucleotides 253831-491909 of NW_006881296.1, nucleotides 69303-79768 of NW_003616412.1, nucleotides 293481-315265 of NW_003615063.1, nucleotides 2650443-2662054 of NW_006882936.1, or nucleotides 82214-97705 of NW_003615411.1 and sequences at least 50% homologous thereto. In certain embodiments, the nucleotide sequence immediately 5' of the integrated exogenous sequence are at least about 50%, at least about 60%, at least about 70%, at least about 80%, at least about 90%, at least about 95%, at least about 99%, or at least about 99.9% homologous to nucleotides 41190-45269 of NW_006874047.1, nucleotides 63590-207911 of NW_006884592.1, nucleotides 253831-491909 of NW_006881296.1, nucleotides 69303-79768 of NW_003616412.1, nucleotides 293481-315265 of NW_003615063.1, nucleotides 2650443-2662054 of NW_006882936.1, or nucleotides 82214-97705 of NW_003615411.1.

In certain embodiments, the nucleotide sequence immediately 3' of the integrated exogenous sequence is selected from the group consisting of nucleotides 45270-45490 of NW_006874047.1, nucleotides 207912-792374 of NW_006884592.1, nucleotides 491910-667813 of NW_006881296.1, nucleotides 79769-100059 of NW_003616412.1, nucleotides 315266-362442 of NW_003615063.1, nucleotides 2662055-2701768 of NW_006882936.1, or nucleotides 97706-105117 of NW_003615411.1 and sequences at least 50% homologous thereto. In certain embodiments, the nucleotide sequence immediately 3' of the integrated exogenous sequence is at least about 50%, at least about 60%, at least about 70%, at least about 80%, at least about 90%, at least about 95%, at least about 99%, or at least about 99.9% homologous to nucleotides 45270-45490 of NW_006874047.1, nucleotides 207912-792374 of NW_006884592.1, nucleotides 491910-667813 of NW_006881296.1, nucleotides 79769-100059 of NW_003616412.1, nucleotides 315266-362442 of NW_003615063.1, nucleotides 2662055-2701768 of NW_006882936.1, or nucleotides 97706-105117 of NW_003615411.1.

In certain embodiments, the integrated exogenous nucleotide sequence is operably linked to a nucleotide sequence selected from the group consisting of SEQ ID. Nos. 1-7 and sequences at least 50% homologous thereto. In certain embodiments, the nucleotide sequence operably linked to the exogenous nucleotide sequence is at least about 50%, at least about 60%, at least about 70%, at least about 80%, at least about 90%, at least about 95%, at least about 99%, or at least about 99.9% homologous to a sequence selected from SEQ ID Nos. 1-7. In certain embodiments, the integrated exogenous nucleotide sequence comprises at least one SOI. In certain embodiments, the operably linked nucleotide sequence increases the expression level of the SOI compared to a randomly integrated SOI. In certain embodiments, the integrated exogenous SOI is expressed at about 20%, 30%, 40%, 50%, 100%, 2 fold, 3 fold, 5 fold, or 10 fold higher than a randomly integrated SOI.

In certain embodiments, the integrated exogenous sequence is flanked 5' by a nucleotide sequence selected from the group consisting of nucleotides 41190-45269 of NW_006874047.1, nucleotides 63590-207911 of NW_006884592.1, nucleotides 253831-491909 of NW_006881296.1, nucleotides 69303-79768 of NW_003616412.1, nucleotides 293481-315265 of NW_003615063.1, nucleotides 2650443-2662054 of NW_006882936.1, and nucleotides 82214-97705 of NW_003615411.1. and sequences at least 50% homologous thereto, and is flanked 3' by a nucleotide sequence selected from the group consisting of nucleotides 45270-45490 of NW_006874047.1, nucleotides 207912-792374 of NW_006884592.1, nucleotides 491910-667813 of NW_006881296.1, nucleotides 79769-100059 of NW_003616412.1, nucleotides 315266-362442 of NW_003615063.1, nucleotides 2662055-2701768 of NW_006882936.1, and nucleotides 97706-105117 of NW_003615411.1 and sequences at least 50% homologous thereto. In certain embodiments, the nucleotide sequence flanking 5' of the integrated exogenous nucleotide sequence is at least about 50%, at least about 60%, at least about 70%, at least about 80%, at least about 90%, at least about 95%, at least about 99%, or at least about 99.9% homologous to nucleotides 41190-45269 of NW_006874047.1, nucleotides 63590-207911 of NW_006884592.1, nucleotides 253831-491909 of NW_006881296.1, nucleotides 69303-79768 of NW_003616412.1, nucleotides 293481-315265 of NW_003615063.1, nucleotides 2650443-2662054 of NW_006882936.1, and nucleotides 82214-97705 of NW_003615411.1, and the nucleotide sequences flanking 3' of the integrated exogenous nucleotide sequence is at least about 50%, at least about 60%, at least about 70%, at least about 80%, at least about 90%, at least about 95%, at least about 99%, or at least about 99.9% homologous to SEQ ID Nos. nucleotides 45270-45490 of NW_006874047.1, nucleotides 207912-792374 of NW_006884592.1, nucleotides 491910-667813 of NW_006881296.1, nucleotides 79769-100059 of NW_003616412.1, nucleotides 315266-362442 of NW_003615063.1, nucleotides 2662055-2701768 of NW_006882936.1, and nucleotides 97706-105117 of NW_003615411.1.

In certain embodiments, the integrated exogenous nucleotide is integrated into a locus immediately adjacent to all or a portion of a sequence selected from the group consisting of sequences at least about 90% homologous to a sequence selected from SEQ ID Nos. 1-7.

In certain embodiments, the integrated exogenous nucleotide sequence is adjacent to a nucleotide sequence selected from the group consisting of SEQ ID. Nos. 1-7 and sequences at least 50% homologous thereto. In certain embodiments, the integrated exogenous nucleotide sequence is within about 100 bp, about 200 bp, about 500 bp, about 1 kb distance from a sequence selected from the group consisting of SEQ ID. Nos. 1-7 and sequences at least 50% homologous thereto. In certain embodiments, the nucleotide sequence adjacent to the exogenous nucleotide sequence is at least about 50%, at least about 60%, at least about 70%, at least about 80%, at least about 90%, at least about 95%, at least about 99%, or at least about 99.9% homologous to a sequence selected from SEQ ID Nos. 1-7.

In certain embodiments, the exogenous nucleotide sequence is integrated at an integration site adjacent to a position selected from nucleotides numbered 1-1,000 bp; 1,000-2,000 bp; 2,000-3,000 bp; 3,000-4,000 bp; and 4,000-4,301 bp of SEQ ID No. 1. In certain embodiments, the exogenous nucleotide sequence is integrated at an integration site adjacent to a position selected from nucleotides numbered 1-100,000 bp; 100,000-200,000 bp; 200,000-300,000 bp; 300,000-400,000 bp; 400,000-500,000 bp; 500,000-600,000 bp; 600,000-700,000 bp; and 700,000-728785 bp of SEQ ID No. 2. In certain embodiments, the exogenous nucleotide sequence is integrated at an integration site adjacent to a position selected from nucleotides numbered 1-100,000 bp; 100,000-200,000 bp; 200,000-300,000 bp; 300,000-400,000 bp; and 400,000-413,983 of SEQ ID No. 3. In certain embodiments, the exogenous nucleotide sequence is integrated at an integration site adjacent to a position selected from nucleotides numbered 1-10,000 bp; 10,000-20,000 bp; 20,000-30,000 bp; and 30,000-30,757 bp of SEQ ID No. 4. In certain embodiments, the exogenous nucleotide sequence is integrated at an integration site adjacent to a position selected from nucleotides numbered 1-10,000 bp; 10,000-20,000 bp; 20,000-30,000 bp; 30,000-40,000 bp; 40,000-50,000 bp; 50,000-60,000 bp; and 60,000-68,962 bp of SEQ ID No. 5. In certain embodiments, the exogenous nucleotide sequence is integrated at an integration site adjacent to a position selected from nucleotides numbered 1-10,000 bp; 10,000-20,000 bp; 20,000-30,000 bp; 30,000-40,000 bp; 40,000-50,000 bp; and 50,000-51,326 bp of SEQ ID No. 6. In certain embodiments, the exogenous nucleotide sequence is integrated at an integration site adjacent to a position selected from nucleotides numbered 1-10,000 bp; 10,000-20,000 bp; and 20,000-22,904 bp of SEQ ID No. 7.

In certain embodiments, the locus comprising the integration site of the exogenous nucleotide sequence does not encode an open reading frame (ORF). In certain embodiments, the locus comprising the integration site of the exogenous nucleotide sequence includes cis-acting elements, e.g., promoters and enhancers. In certain embodiments, the locus comprising the integration site of the exogenous nucleotide sequence is free of any cis-acting elements, e.g., promoters and enhancers, that enhance gene expression.

In certain embodiments, an exogenous nucleotide sequence is integrated at an integration site within an endogenous gene selected from the group consisting of LOC107977062, LOC100768845, ITPR2, ERE67000.1, UBAP2, MTMR2, and XP_003512331.2. The endogenous LOC107977062, LOC100768845, ITPR2, ERE67000.1, UBAP2, MTMR2, and XP_003512331.2 genes include the wild-type and all homologous sequences of LOC107977062, LOC100768845, ITPR2, ERE67000.1, UBAP2, MTMR2, and XP_003512331.2 genes. In certain embodiments, the homologous sequences of LOC107977062, LOC100768845, ITPR2, ERE67000.1, UBAP2, MTMR2, and XP_003512331.2 genes can be at least about 50%, at least about 60%, at least about 70%, at least about 80%, at least about 90%, at least about 95%, at least about 99%, or at least about 99.9% homologous to the wild-type LOC107977062, LOC100768845, ITPR2, ERE67000.1, UBAP2, MTMR2, and XP_003512331.2 genes. In certain embodiments, the LOC107977062, LOC100768845, ITPR2, ERE67000.1, UBAP2, MTMR2, and XP_003512331.2 genes are wild-type mammalian LOC107977062, LOC100768845, ITPR2, ERE67000.1, UBAP2, MTMR2, and XP_003512331.2 genes. In certain embodiments, the LOC107977062, LOC100768845, ITPR2, ERE67000.1, UBAP2, MTMR2, and XP_003512331.2 genes are wild-type human LOC107977062, LOC100768845, ITPR2, ERE67000.1, UBAP2, MTMR2, and XP_003512331.2 genes. In certain embodiments, the LOC107977062, LOC100768845, ITPR2, ERE67000.1, UBAP2, MTMR2, and XP_003512331.2 genes are wild-type hamster LOC107977062, LOC100768845, ITPR2, ERE67000.1, UBAP2, MTMR2, and XP_003512331.2 genes.

In certain embodiments, the integration site is operably linked to an endogenous gene selected from the group consisting of LOC107977062, LOC100768845, ITPR2, ERE67000.1, UBAP2, MTMR2, XP_003512331.2, and at least about 90% homologous sequences thereof. In certain embodiments, the integration site is flanked by an endogenous gene selected from the group consisting of LOC107977062, LOC100768845, ITPR2, ERE67000.1, UBAP2, MTMR2, XP_003512331.2, and at least about 90% homologous sequences thereof.

Table 1 provides exemplary TI host cell integration sites:

TABLE 1

| | | | | |
|---|---|---|---|---|
| | | | TI host cell integration sites | |
| Host | Contig | Contig Size (kb) | Integration site (bp) | Gene (SEQ ID No.) |
| 1 | NW_006874047.1 | 727 | 45269 | LOC107977062 (SEQ ID No. 1) |
| 2 | NW_006884592.1 | 931 | 207911 | LOC100768845 (SEQ ID No. 2) |
| 3 | NW_006881296.1 | 1016 | 491909 | ITPR2 (SEQ ID No. 3) |
| 4 | NW_003616412.1 | 127 | 79768 | ERE67000.1 (SEQ ID No. 4) |
| 5 | NW_003615063.1 | 372 | 315265 | UBAP2 (SEQ ID No. 5) |
| 6 | NW_006882936.1 | 3042 | 2662054 | MTMR2 (SEQ ID No. 6) |
| 7 | NW_003615411.1 | 277 | 97706 | XP_003512331.2 (SEQ ID No. 7) |

3.2 Exogenous Nucleotide Sequence Comprising a Sequence of Interest

In certain embodiments, the integrated exogenous nucleotide sequence comprises at least one exogenous SOI. In certain embodiments, the integrated exogenous nucleotide sequence comprises at least one selection marker and at least one exogenous SOI. In certain embodiments, the integrated exogenous nucleotide sequence comprises at least one selection marker, at least one exogenous SOI, and at least one RRS. In certain embodiments, the integrated exogenous nucleotide sequence comprises at least one, at least two, at least three, at least four, at least five, at least six, at least seven, at least eight, at least nine, at least ten, or more SOIs. In certain embodiments the SOIs are the same. In certain embodiments, the SOIs are different.

As noted above, in certain embodiments, the SOI encodes one or more subunits of a multi-subunit protein complex. In certain embodiments, such polypeptide sequences can comprise fragments of such subunit sequences. In certain embodiments, the sequences of interest can comprise combinations of such subunit sequences. For example, but not by way of limitation, such combinations can comprise one, two, three, four, five, six, seven, eight, nine, ten, or more of a first subunit sequence and/or one, two, three, four, five, six, seven, eight, nine, ten, or more sequences of a second, third, fourth, fifth, sixth, seventh, eighth, ninth, tenth, or more subunit sequence. Moreover, in certain embodiments, such combinations can comprise one, two, three, four, five, six, seven, eight, nine, ten, or more distinct variations of a first subunit sequence and/or one, two, three, four, five, six, seven, eight, nine, ten, or more distinct variations of a second, third, fourth, fifth, sixth, seventh, eighth, ninth, tenth, or more subunit sequence.

In certain embodiments the SOI encodes a single chain antibody or fragment thereof. In certain embodiments, the SOI encodes an antibody heavy chain sequence or fragment thereof. In certain embodiments, the SOI encodes an antibody light chain sequence or fragment thereof. In certain embodiments, an integrated exogenous nucleotide sequence comprises an SOI encoding an antibody heavy chain sequence or fragment thereof and an SOI encoding an antibody light chain sequence or fragment thereof. In certain embodiments, an integrated exogenous nucleotide sequence comprises an SOI encoding a first antibody heavy chain sequence or fragment thereof, an SOI encoding a second antibody heavy chain sequence or fragment thereof, and an SOI encoding an antibody light chain sequence or fragment thereof. In certain embodiments, an integrated exogenous nucleotide sequence comprises an SOI encoding a first antibody heavy chain sequence or fragment thereof, an SOI encoding a second antibody heavy chain sequence or fragment thereof, an SOI encoding a first antibody light chain sequence or fragment thereof and a second SOI encoding an antibody light chain sequence or fragment thereof. In certain embodiments, the number of SOIs encoding for heavy and light chain sequences can be selected to achieve a desired expression level of the heavy and light chain polypeptides, e.g., to achieve a desired amount of bispecific antibody production. In certain embodiments, the individual SOIs encoding heavy and light chain sequences can be integrated, e.g., into a single exogenous nucleic acid sequence present at a single integration site, into multiple exogenous nucleic acid sequences present at a single integration site, or into multiple exogenous nucleic acid sequences integrated at distinct integrations sites within the TI host cell.

In certain embodiments, the integrated exogenous nucleotide sequence comprises at least one selection marker, at least one exogenous SOI, and one RRS. In certain embodiments, the RRS is located adjacent to at least one selection marker or at least one exogenous SOI. In certain embodiments, the integrated exogenous nucleotide sequence comprises at least one selection marker, at least one exogenous SOI, and two RRSs. In certain embodiments, the integrated exogenous nucleotide sequence comprises at least one selection marker and at least one exogenous SOI located between the first and the second RRS. In certain embodiments, the two RRSs flanking the selection marker and the exogenous SOI are the same. In certain embodiments, the two RRSs flanking the selection marker and the exogenous SOI are different. In certain embodiments, the first flanking RRS is a LoxP L3 sequence and the second flanking RRS is a LoxP 2L sequence. In certain embodiments, a L3 LoxP sequence is located 5' of the selection marker and the exogenous SOI, and a LoxP 2L sequence is located 3' of the selection marker and the exogenous SOI.

In certain embodiments, the integrated exogenous nucleotide sequence comprises three RRSs and two exogenous SOIs, and the third RRS is located between the first and the second RRS. In certain embodiments, the first SOI is located between the first and the third RRS, and the second SOI is located between the third and the second RRS. In certain embodiments, the first and the second SOI are different. In certain embodiments, the first and the second RRS are the same and the third RRS is different from the first or the second RRS. In certain embodiments, all three RRSs are different. In certain embodiments, the first RRS is a LoxP L3 site, the second RRS is a LoxP 2L site, and the third RRS is a LoxFas site. In certain embodiments, the integrated exogenous nucleotide sequence comprises three RRSs, one exogenous SOI, and one selection marker. In certain embodiments, the SOI is located between the first and the third RRS, and the selection marker is located between the third and the second RRS. In certain embodiments, the integrated exogenous nucleotide sequence comprises three RRSs, two exogenous SOIs, and one selection marker. In certain embodiments, the first SOI and the selection marker are located between the first and the third RRS, and the second SOI is located between the third and the second RRS.

In certain embodiments, the exogenous SOI encodes a polypeptide of interest including, but not limited to, an antibody, an enzyme, a cytokine, a growth factor, a hormone, a viral protein, a bacterial protein, a vaccine protein, or a protein with therapeutic function. In certain embodiments, the exogenous SOI encodes an antibody or an antigen-binding fragment thereof. In certain embodiments, the exogenous SOI encodes a single chain antibody, an antibody light chain, an antibody heavy chain, a single-chain Fv fragment (scFv), or an Fc fusion protein. In certain embodiments, the exogenous SOI is operably linked to at least one cis-acting element, for example, a promoter or an enhancer. In certain embodiments, the exogenous SOI is operably linked to a CMV promoter.

In certain embodiments, the integrated exogenous nucleotide sequence comprises two RRSs and at least two exogenous SOIs located between the two RRSs. In certain embodiments, SOIs encoding one heavy chain and one light chain of an antibody are located between the two RRSs. In certain embodiments, SOIs encoding one heavy chain and two light chains of an antibody are located between the two RRSs. In certain embodiments, SOIs encoding different combinations of copies of heavy chain and light chain of an antibody are located between the two RRSs.

In certain embodiments, the integrated exogenous nucleotide sequence comprises three RRSs and at least two exogenous SOIs, and the third RRS is located between the first and the second RRS. In certain embodiments, at least one SOI is located between the first and the third RRS, and at least one SOI is located between the third and the second RRS. In certain embodiments, the first and the second RRS are the same and the third RRS is different from the first or the second RRS. In certain embodiments, all three RRSs are different. In certain embodiments, SOIs encoding one heavy chain and one light chain of a first antibody are located between the first and the third RRS, and SOIs encoding one heavy chain and one light chain of a second antibody are located between the third and the second RRS. In certain embodiments, SOIs encoding one heavy chain and two light chains of a first antibody are located between the first and the third RRS, and SOIs encoding one heavy chain and one light chain of a second antibody are located between the third RRS and the second RRS. In certain embodiments, SOIs encoding one heavy chain and three light chains of a first antibody are located between the first and the third RRS, and SOIs encoding one light chain of the first antibody and one heavy chain and one light chain of a second antibody are located between the third RRS and the second RRS. In certain embodiments, SOIs encoding one heavy chain and three light chains of a first antibody are located between the first and the third RRS, and SOIs encoding two light chains of the first antibody and one heavy chain and one light chain of a second antibody are located between the third RRS and the second RRS. In certain embodiments, SOIs encoding different combinations of copies of heavy chains and light chains of multiple antibodies are located between the first and the third RRS, and between the third and the second RRS.

4. Host Cells

In certain embodiments, a host cell is a eukaryotic host cell. In certain embodiments, a host cell is a mammalian host cell. In certain embodiments, a host cell is a hamster host cell, a human host cell, a rat host cell, or a mouse host cell. In certain embodiments, a host cell is a Chinese hamster ovary (CHO) host cell, a CHO K1 host cell, a CHO K1SV host cell, a DG44 host cell, a DUKXB-11 host cell, a CHOK1S host cell, or a CHO KIM host cell.

In certain embodiments, a host cell is selected from the group consisting of monkey kidney CV1 line transformed by SV40 (COS-7), human embryonic kidney line (293 or 293 cells as described, e.g., in Graham et al., *J. Gen Virol.* 36:59 (1977)), baby hamster kidney cells (BHK), mouse sertoli cells (TM4 cells as described, e.g., in Mather, *Biol. Reprod.* 23:243-251 (1980)), monkey kidney cells (CV1), African green monkey kidney cells (VERO-76), human cervical carcinoma cells (HELA), canine kidney cells (MDCK; buffalo rat liver cells (BRL 3A), human lung cells (W138), human liver cells (Hep G2), mouse mammary tumor (MMT 060562), TRI cells, as described, e.g., in Mather et al., *Annals N.Y. Acad. Sci.* 383:44-68 (1982), MRC 5 cells, FS4 cells, YO cells, NSO cells, Sp2/0 cells, and PER.C6® cells.

In certain embodiments, a host cell is a cell line. In certain embodiments, a host cell is a cell line that has been cultured for a certain number of generations. In certain embodiments, a host cell is a primary cell.

In certain embodiments, expression of a polypeptide of interest is stable if the expression level is maintained at certain levels, increases, or decreases less than 20%, over 10, 20, 30, 50, 100, 200, or 300 generations. In certain embodiments, expression of a polypeptide of interest is stable if the culture can be maintained without any selection. In certain embodiments, expression of a polypeptide of interest is high if the polypeptide product of the gene of interest reaches about 1 g/L, about 2 g/L, about 3 g/L, about 4 g/L, about 5 g/L, about 10 g/L, about 12 g/L, about 14 g/L, or about 16 g/L.

In certain embodiments, polypeptide of interest is produced and secreted into the cell culture medium. In certain embodiments, polypeptide of interest is expressed and retained within the host cell. In certain embodiments, polypeptide of interest is expressed, inserted into, and retained in the host cell membrane.

Exogenous nucleotides of interest or vectors can be introduced into a host cell by conventional cell biology methods including, but not limited to, transfection, transduction, electroporation, or injection. In certain embodiments, exogenous nucleotides of interest or vectors are introduced into a host cell by chemical-based transfection methods comprising lipid-based transfection method, calcium phosphate-based transfection method, cationic polymer-based transfection method, or nanoparticle-based transfection. In certain embodiments, exogenous nucleotides of interest are introduced into a host cell by virus-mediated transduction including, but not limited to, lentivirus, retrovirus, adenovirus, or adeno-associated virus-mediated transduction. In certain embodiments, exogenous nucleotides of interest or vectors are introduced into a host cell via gene gun-mediated injection. In certain embodiments, both DNA and RNA molecules are introduced into a host cell using methods described herein.

5. Targeted Integration

A targeted integration approach allows for exogenous nucleotide sequences to be integrated into one or more pre-determined sites of a host cell genome. In certain embodiments, the targeted integration is mediated by a recombinase that recognizes one or more RRSs. In certain embodiments, the targeted integration is mediated by homologous recombination. In certain embodiments, the targeted integration is mediated by an exogenous site-specific nuclease followed by HDR and/or NHEJ.

5.1. Targeted Integration Via Recombinase-Mediated Recombination

A "recombinase recognition sequence" (RRS) is a nucleotide sequence recognized by a recombinase and is necessary and sufficient for recombinase-mediated recombination events. A RRS can be used to define the position where a recombination event will occur in a nucleotide sequence.

In certain embodiments, a RRS is selected from the group consisting of a LoxP sequence, a LoxP L3 sequence, a LoxP 2L sequence, a LoxFas sequence, a Lox511 sequence, a Lox2272 sequence, a Lox2372 sequence, a Lox5171 sequence, a Loxm2 sequence, a Lox71 sequence, a Lox66 sequence, a FRT sequence, a Bxbl attP sequence, a Bxbl attB sequence, a φC31 attP sequence, and a φC31 attB sequence.

In certain embodiments, a RRS can be recognized by a Cre recombinase. In certain embodiments, a RRS can be recognized by a FLP recombinase. In certain embodiments, a RRS can be recognized by a Bxbl integrase. In certain embodiments, a RRS can be recognized by a φC31 integrase.

In certain embodiments when the RRS is a LoxP site, the host cell requires the Cre recombinase to perform the recombination. In certain embodiments when the RRS is a FRT site, the host cell requires the FLP recombinase to perform the recombination. In certain embodiments when the RRS is a Bxbl attP or a Bxbl attB site, the host cell requires the Bxbl integrase to perform the recombination. In certain embodiments when the RRS is a φC31 attP or a φC31 attB site, the host cell requires the φC31 integrase to perform the recombination. The recombinases can be introduced into a host cell using an expression vector comprising coding sequences of the enzymes.

The Cre-LoxP site-specific recombination system has been widely used in many biological experimental systems. Cre is a 38-kDa site-specific DNA recombinase that recognizes 34 bp LoxP sequences. Cre is derived from bacteriophase P1 and belongs to the tyrosine family site-specific recombinase. Cre recombinase can mediate both intra and intermolecular recombination between LoxP sequences. The LoxP sequence is composed of an 8 bp nonpalindromic core region flanked by two 13 bp inverted repeats. Cre recombinase binds to the 13 bp repeat thereby mediating recombination within the 8 bp core region. Cre-LoxP-mediated recombination occurs at a high efficiency and does not require any other host factors. If two LoxP sequences are placed in the same orientation on the same nucleotide sequence, Cre-mediated recombination will excise DNA sequences located between the two LoxP sequences as a covalently closed circle. If two LoxP sequences are placed in an inverted position on the same nucleotide sequence, Cre-mediated recombination will invert the orientation of the DNA sequences located between the two sequences. LoxP sequences can also be placed on different chromosomes to facilitate recombination between different chromosomes. If two LoxP sequences are on two different DNA molecules and if one DNA molecule is circular, Cre-mediated recombination will result in integration of the circular DNA sequence.

In certain embodiments, a LoxP sequence is a wild-type LoxP sequence. In certain embodiments, a LoxP sequence is a mutant LoxP sequence. Mutant LoxP sequences have been developed to increase the efficiency of Cre-mediated integration or replacement. In certain embodiments, a mutant LoxP sequence is selected from the group consisting of a LoxP L3 sequence, a LoxP 2L sequence, a LoxFas sequence, a Lox511 sequence, a Lox2272 sequence, a Lox2372 sequence, a Lox5171 sequence, a Loxm2 sequence, a Lox71 sequence, and a Lox66 sequence. For example, the Lox71 sequence has 5 bp mutated in the left 13 bp repeat. The Lox66 sequence has 5 bp mutated in the right 13 bp repeat. Both the wild-type and the mutant LoxP sequences can mediate Cre-dependent recombination.

The FLP-FRT site-specific recombination system is similar to the Cre-Lox system. It involves the flippase (FLP) recombinase, which is derived from the 2 μm plasmid of the yeast Saccharomyces cerevisiae. FLP also belongs to the tyrosine family site-specific recombinase. The FRT sequence is a 34 bp sequence that consists of two palindromic sequences of 13 bp each flanking an 8 bp spacer. FLP binds to the 13 bp palindromic sequences and mediates DNA break, exchange and ligation within the 8 bp spacer. Similar to the Cre recombinase, the position and orientation of the two FRT sequences determine the outcome of FLP-mediated recombination. In certain embodiments, a FRT sequence is a wild-type FRT sequence. In certain embodiments, a FRT sequence is a mutant FRT sequence. Both the wild-type and the mutant FRT sequences can mediate FLP-dependent recombination. In certain embodiments, a FRT sequence is fused to a responsive receptor domain sequence, such as, but not limited to, a tamoxifen responsive receptor domain sequence.

Bxb1 and φC31 belong to the serine recombinase family. They are both derived from bacteriophages and are used by these bacteriophages to establish lysogeny to facilitate site-specific integration of the phage genome into the bacterial genome. These integrases catalyze site-specific recombination events between short (40-60 bp) DNA substrates termed attP and attB sequences that are originally attachment sites located on the phage DNA and bacterial DNA, respectively. After recombination, two new sequences are formed, which are termed attL and attR sequences and each contains half sequences derived from attP and attB. Recombination can also occur between attL and attR sequences to excise the integrated phage out of the bacterial DNA. Both integrases can catalyze the recombination without the aid of any additional host factors. In the absence of any accessory factors, these integrases mediate unidirectional recombination between attP and attB with greater than 80% efficiency. Because of the short DNA sequences that can be recognized by these integrases and the unidirectional recombination, these recombination systems have been developed as a complement to the widely-used Cre-LoxP and FRT-FLP systems for genetic engineering purposes.

The term "matching RRSs" indicates that a recombination occurs between two RRSs. In certain embodiments, the two matching RRSs are the same. In certain embodiments, both RRSs are wild-type LoxP sequences. In certain embodiments, both RRSs are mutant LoxP sequences. In certain embodiments, both RRSs are wild-type FRT sequences. In certain embodiments, both RRSs are mutant FRT sequences. In certain embodiments, the two matching RRSs are different sequences but can be recognized by the same recombinase. In certain embodiments, the first matching RRS is a Bxb1 attP sequence and the second matching RRS is a Bxb1 attB sequence. In certain embodiments, the first matching RRS is a φC31 attB sequence and the second matching RRS is a φC31 attB sequence.

In certain embodiments, a "single-vector RMCE" strategy is employed. For example, in certain embodiments, an integrated exogenous nucleotide sequence comprises two RRSs and a vector comprises two RRSs matching the two RRSs on the integrated exogenous nucleotide sequence, i.e., the first RRS on the integrated exogenous nucleotide sequence matches the first RRS on the vector and the second RRS on the integrated exogenous nucleotide sequence matches the second RRS on the vector. In certain embodiments, the first RRS on the integrated exogenous nucleotide sequence and the first RRS on the vector are the same as the second RRS on the integrated exogenous nucleotide sequence and the second RRS on the vector. In certain embodiments, the first RRS on the integrated exogenous nucleotide sequence and the first RRS on the vector are different from the second RRS on the integrated exogenous nucleotide sequence and the second RRS on the vector. In certain embodiments, the first RRS on the integrated exogenous nucleotide sequence and the first RRS on the vector are both LoxP L3 sequences, and the second RRS on the integrated exogenous nucleotide sequence and the second RRS on the vector are both LoxP 2L sequences.

In certain embodiments, a "two-vector RMCE" strategy is employed. For example, but not by way of limitation, an integrated exogenous nucleotide sequence could comprise three RRSs, e.g., an arrangement where the third RRS ("RRS3") is present between the first RRS ("RRS1") and the second RRS ("RRS2"), while a first vector comprises two RRSs matching the first and the third RRS on the integrated exogenous nucleotide sequence, and a second vector comprises two RRSs matching the third and the second RRS on the integrated exogenous nucleotide sequence. Such two vector RMCE strategies allow for the introduction of ten or more SOIs by incorporating the appropriate number of SOIs between each pair of RRSs.

Both single-vector and two-vector RMCE allow for unidirectional integration of one or more donor DNA molecule(s) into a pre-determined site of a host cell genome, and precise exchange of a DNA cassette present on the donor DNA with a DNA cassette on the host genome where the integration site resides. The DNA cassettes are characterized by two heterospecific RRSs flanking at least one selection marker (although in certain two-vector RMCE examples a "split selection marker" can be used as outlined herein) and/or at least one exogenous SOI. RMCE involves double recombination cross-over events, catalyzed by a recombinase, between the two heterospecific RRSs within the target genomic locus and the donor DNA molecule. RMCE is designed to introduce a copy of the SOI or selection marker into the pre-determined locus of a host cell genome. Unlike recombination which involves just one cross-over event, RMCE can be implemented such that prokaryotic vector sequences are not introduced into the host cell genome, thus reducing and/or preventing unwanted triggering of host immune or defense mechanisms. The RMCE procedure can be repeated with multiple DNA cassettes, for example, in FIG. 2B, the RMCE procedure is employed to facilitate the introduction of three distinct "front" cassettes and three distinct "back" cassettes. As noted above, however, RMCE (and other integration strategies) can be employed to introduce as few as one cassette and as many as ten or more cassettes.

In certain embodiments, targeted integration is achieved by one cross-over recombination event, wherein one exogenous nucleotide sequence comprising one RRS adjacent to at least one exogenous SOI or at least one selection marker is integrated into a pre-determined site of a host cell genome. In certain embodiments, targeted integration is achieved by one RMCE, wherein a DNA cassette comprising at least an exogenous SOI or at least one selection marker flanked by two heterospecfic RRSs is integrated into a pre-determined site of a host cell genome. In certain embodiments, targeted integration is achieved by two RMCEs, wherein two different DNA cassettes, each comprising at least an exogenous SOI or at least one selection marker flanked by two heterospecific RRSs, are both integrated into a pre-determined site of a host cell genome. In certain embodiments, targeted integration is achieved by multiple RMCEs, wherein DNA cassettes from multiple vectors, each comprising at least an exogenous SOI or at least one selection marker flanked by two heterospecific RRSs, are all integrated into a pre-determined site of a host cell genome. In certain embodiments the selection marker can be partially encoded on the first the vector and partially encoded on the second vector such that the integration of both RMCEs allows for the expression of the selection marker.

In certain embodiments, targeted integration via recombinase-mediated recombination leads to a selection marker or one or more exogenous SOI integrated into one or more pre-determined integration sites of a host cell genome along with sequences from a prokaryotic vector. In certain embodiments, targeted integration via recombinase-mediated recombination leads to selection marker or one or more exogenous SOI integrated into one or more pre-determined integration sites of a host cell genome free of sequences from a prokaryotic vector.

5.2 Targeted Integration Via Homologous Recombination, HDR, or NHEJ

The presently disclosed subject matter also relates to targeted integration mediated by homologous recombination or by an exogenous site-specific nuclease followed by HDR or NHEJ. In certain embodiments, such integration is referred herein as "gene editing-mediated integration."

Homologous recombination is a recombination between DNA molecules that share extensive sequence homology. It can be used to direct error-free repair of double-stranded DNA breaks and generates sequence variation in gametes during meiosis. Since homologous recombination involves the exchange of genetic information between two homologous DNA molecules, it does not alter the overall arrangement of the genes on a chromosome. During homologous recombination, a nick or break forms in double-stranded DNA (dsDNA), followed by the invasion of a homologous dsDNA molecule by a single-stranded DNA end, pairing of homologous sequences, branch migration to form a Holliday junction, and final resolution of the Holliday junction.

Double-strand break (DSB) is the most severe form of DNA damage and repair of such DNA damage is essential for the maintenance of genome integrity in all organisms. There are two major repair pathways to repair DSBs. The first repair pathway is homology-directed repair (HDR) pathway and homologous recombination is the most common form of HDR. Since HDR requires the presence of homologous DNA present in the cell, this repair pathway is normally active in S and G2 phase of the cell cycle wherein newly replicated sister chromatids are available as homologous templates. HDR is also a major repair pathway to repair collapsed replication forks during DNA replication. HDR is considered as a relatively error-free repair pathway. The second repair pathway for DSBs is non-homologous end joining (NHEJ). NHEJ is a repair pathway wherein the ends of a broken DNA are ligated together without the requirement for a homologous DNA template.

Targeted integration can be facilitated by exogenous site-specific nucleases, e.g., gene editing nucleases, followed by HDR. This is due to that the frequency of homologous recombination can be increased by introducing a DSB at a specific target genomic site. In certain embodiments, an exogenous nuclease can be selected from the group consisting of a zinc finger nuclease (ZFN), a ZFN dimer, a transcription activator-like effector nuclease (TALEN), a TAL effector domain fusion protein, an RNA-guided DNA endonuclease, an engineered meganuclease, and a clustered regularly interspaced short palindromic repeats (CRISPR)-associated (Cas) endonuclease.

CRISPR/Cas and TALEN systems are two genome editing tools that offer the best ease of construction and high efficiency. CRISPR/Cas was identified as an immune defense mechanism of bacteria against invading bacteriophages. Cas is a nuclease that, when guided by a synthetic guide RNA (gRNA), is capable of associating with a specific nucleotide sequence in a cell and editing the DNA in or around that nucleotide sequence, for instance by making one or more of a single-strand break, a DSB, and/or a point mutation. TALEN is an engineered site-specific nuclease, which is composed of the DNA-binding domain of TALE (transcription activator-like effectors) and the catalytic domain of restriction endonuclease Fokl. By changing the amino acids present in the highly variable residue region of the monomers of the DNA binding domain, different artificial TALENs can be created to target various nucleotides sequences. The DNA binding domain subsequently directs the nuclease to the target sequences and creates a DSB.

Targeted integration via homologous recombination or HDR involves the presence of homologous sequences to the integration site. In certain embodiments, the homologous sequences are present on a vector. In certain embodiments, the homologous sequences are present on a polynucleotide.

In certain embodiments, homologous recombination is carried out without any accessory factors. In certain embodiments, homologous recombination is facilitated by the presence of vectors that are capable of integration. In certain embodiments, an integrating vector is selected from the group consisting of an adeno-associated virus vector, a lentivirus vector, a retrovirus vector, and an integrating phage vector.

5.3 Regulated Systems

The presently disclosed subject matter also relates to regulated systems for use in RCTI, known as "Randomized Configuration Regulated Targeted Integration" (also referred to herein as "randomized chain regulated targeted integration") ("RCRTI"). For example, there are many cases where protein expression levels are not optimal mainly because the encoded proteins are difficult-to-express. The low expression level of difficult-to-express proteins can have diverse and difficult to identify causes. One possibility is the toxicity of the expressed proteins in the host cells. In such cases, a regulated expression system can be used to express toxic proteins where the sequences of interest encoding the proteins are under the control of an inducible promoter. In these systems, expression of the difficult-to-express proteins is only prompted when a regulator, e.g., small molecule, such as, but not limited to, tetracycline or its analogue, doxycycline (DOX), is added to the culture. Regulating the expression of toxic proteins could alleviate the toxic effects, allowing the cultures to achieve the desired cell growth prior to production. In certain embodiments, a "Randomized Configuration Regulated Targeted Integration" (also referred to herein as "randomized chain regulated target integration") (RCRTI) system comprises a SOI that is integrated into a specific locus, e.g., an exogenous nucleic acid sequence comprising one or more RRSs, and is transcribed under a regulated promoter operably linked thereto. In certain embodiments, an RCRTI system can be used to determine the underlying causes of low protein expression for a difficult-to-express molecule, such as, but not limited to, an antibody. In certain embodiments, the ability to selectively turn off the expression of a SOI in an RCRTI system can be used to link expression of a SOI to an observed adverse effect.

In certain embodiments, to minimize transcriptional and cell line variability effects during the root cause analysis of difficult-to-express molecules, a "Randomized Configuration Regulated Targeted Integration" (also referred to herein as "randomized chain regulated target integration") (RCRTI) system can be used. For example, but not by way of limitation, the expression of the SOI in a TI host can be triggered by addition to the culture of a regulator, e.g., doxycycline. In certain embodiments, the RCRTI vector utilizes a tetracycline-regulated promoter to express the SOT, which can be integrated into, e.g., an exogenous nucleic acid sequence comprising an RRS, which is itself integrated into an integration site in the host cell's genome, allowing for regulated expression of the SOI.

In certain embodiments, the RCRTI system described in the present disclosure can be used to successfully determine the underlying cause(s) of low protein expression of an SOT, e.g., a therapeutic antibody, as compared to control cell line. In certain embodiments, once the lower relative expression of a SOT, e.g., a therapeutic antibody, in an RCRTI cell line is confirmed, the intracellular accumulation and secretion levels of the SOI can be evaluated by leveraging protein translation inhibitor treatments, e.g., Dox and cycloheximide.

For example, but not by way limitation, such regulation can be based on gene switches for blocking or activating mRNA synthesis by regulated coupling of transcriptional repressors or activators to constitutive or minimal promoters. In certain non-limiting embodiments, repression can be achieved by binding the repressor proteins, e.g., where the proteins sterically block transcriptional initiation, or by actively repressing transcription through transcriptional silencers. In certain non-limiting embodiments, activation of mammalian or viral enhancerless minimal promoters can be achieved by the regulated coupling to an activation domain.

In certain embodiments, the conditional coupling of transcriptional repressors or activators can be achieved by using allosteric proteins that bind the promoters in response to external stimuli. In certain embodiments, the conditional coupling of transcriptional repressors or activators can be achieved by using intracellular receptors that are released from sequestering proteins and, thus, can bind target promoters. In certain embodiments, the conditional coupling of transcriptional repressors or activators can be achieved by using chemically induced dimerizers.

In certain embodiments, the allosteric proteins used in the TI systems of the present disclosure can be proteins that modulate transcriptional activity in response to antibiotics, bacterial quorum-sensing messengers, catabolites, or to the cultivation parameters, such as temperature, e.g. cold or heat. In certain embodiments, such RCRTI systems can be catabolite-based, e.g., where a bacterial repressor that controls catabolic genes for alternative carbon sources has been transferred to mammalian cells. In certain embodiments, the repression of the target promoter can be achieved by cumate-responsive binding of the repressor CymR. In certain embodiments, the catabolite-based system can rely on the activation of chimeric promoters by 6-hydroxynicotine-responsive binding of the prokaryotic repressor HdnoR, fused to the Herpes simplex VP16 transactivation domain.

In certain embodiments the TI system can be a quorum-sensing-based expression system originated from prokaryotes that manage intra- and inter-population communication by quorum-sensing molecules. These quorum-sensing molecules bind to receptors in target cells, modulate the receptors' affinity to cognate promoters leading to the initiation of specific regulon switches. In certain embodiments, the quorum-sensing molecule can be the N-(3-oxo-octanoyl)-homoserine lactone in the presence of which, the TraR-p65 fusion protein activates expression from a minimal promoter fused to the TraR-specific operator sequence. In certain embodiments, the quorum-sensing molecule can be the butyrolactone SCB1 (racemic 2-(1'-hydroxy-6-methylheptyl)-3-(hydroxymethyl)-butanolide) in a system based on the *Streptomyces coelicolor* A3(2) ScbR repressor that binds its cognate operator OScbR in the absence of the SCB1. In certain embodiments, the quorum-sensing molecule can be homoserine-derived inducers used in a RTI system wherein *Pseudomonas aeruginosa* quorum-sensing repressors RhlR and LasR are fused to the SV40 T-antigen nuclear localization sequence and the Herpes simplex VP16 domain and can activate promoters containing specific operator sequences (las boxes).

In certain embodiments, the inducing molecules that modulate the allosteric proteins used in the RCRTI systems of the present disclosure can be, but are not limited to, cumate, isopropyl-β-D-galactopyranoside (IPTG), macrolides, 6-hydroxynicotine, doxycycline, streptogramins, NADH, tetracycline.

In certain embodiments, the intracellular receptors used in the RCRTI systems of the present disclosure can be cytoplasmic or nuclear receptors. In certain embodiments, the RCRTI systems of the present disclosure can utilize the release of transcription factors from sequestering and inhibiting proteins by using small molecules. In certain embodiments, the RCRTI systems of the present disclosure can rely on steroid-regulation, wherein a hormone receptor is fused to a natural or an artificial transcription factor that can be released from HSP90 in the cytosol, migrate into the nucleus and activate selected promoters. In certain embodiments, mutant receptors can be used that are regulated by synthetic steroid analogs in order to avoid crosstalk by endogenous steroid hormones. In certain embodiments the receptors can be an estrogen receptor variant responsive to 4-hydroxytamoxifen or a progesterone-receptor mutant inducible by RU486. In certain embodiments, the nuclear receptor-derived rosiglitazone-responsive transcription switch based on the human nuclear peroxisome proliferator-activated receptor γ(PPARγ) can be used in the RCRTI systems of the present disclosure. In certain embodiments, a variant of steroid-responsive receptors can be the RheoSwitch, that is based on a modified *Choristoneura fumiferana* ecdysone receptor and the mouse retinoid X receptor (RXR) fused to the Gal4 DNA binding domain and the VP16 trans-activator. In the presence of synthetic ecdysone, the RheoSwitch variant can bind and activate a minimal promoter fused to several repeats of the Gal4-response element.

In certain embodiments, the RCRTI systems disclosed herein can utilize chemically induced dimerization of a DNA-binding protein and a transcriptional activator for the activation of a minimal core promoter fused with a cognate operator. In certain embodiments, the RCRTI systems disclosed herein can utilize the rapamycin-regulated dimerization of FKBP with FRB. In this system the FRB is fused to the p65 trans-activator and FKBP is fused to a zinc finger domain specific for cognate operator sites placed upstream of an engineered minimal interleukin-12 promoter. In certain embodiments, the FKBP can be mutated. In certain embodiments, the RCRTI systems disclosed herein can utilize bacterial gyrase B subunit (GyrB), where GyrB dimerizes in the presence of the antibiotic coumermycin and dissociates with novobiocin.

In certain embodiments, the RCRTI systems of the present disclosure can be used for regulated siRNA expression. In certain embodiments, the regulated siRNA expression system can be a tetracycline, a macrolide, or an OFF- and ON-type QuoRex system. In certain embodiments, the RTI system can utilize a Xenopus terminal oligopyrimidine element (TOP), which blocks translational initiation by forming hairpin structures in the 5' untranslated region.

In certain embodiments, the RCRTI systems described in the present disclosure can utilize gas-phase controlled expression, e.g., acetaldehyde-induced regulation (AIR) system. The AIR system can employ the *Aspergillus nidulans* AlcR transcription factor, which specifically activates the PAIR promoter assembled from AlcR-specific operators fused to the minimal human cytomegalovirus promoter in the presence of gaseous or liquid acetaldehyde at nontoxic concentrations.

In certain embodiments, the RCRTI systems of the present disclosure can utilize a Tet-On or a Tet-Off system. In such systems, expression of a one or more SOIs can be regulated by tetracycline or its analogue, doxycycline.

In certain embodiments, the RCRTI system of the present disclosure can utilize a PIP-on or a PIP-off system. In such systems, the expression of SOIs can be regulated by, e.g., pristinamycin, tetracycline and/or erythromycin.

6. Products

The host cells of the present disclosure can be used for the expression of any molecule of interest. In certain embodiments, the host cells of the present disclosure can be used for the expression of polypeptides, e.g., mammalian polypeptides. Non-limiting examples of such polypeptides include hormones, receptors, fusion proteins, regulatory factors, growth factors, complement system factors, enzymes, dotting factors, anti-clotting factors, kinases, cytokines, CD proteins, interleukins, therapeutic proteins, diagnostic proteins and antibodies. In certain embodiments, the host cells of the present disclosure can be used for the expression of chaperones, protein modifying enzymes, shRNA, gRNA or other proteins or peptides while expressing a therapeutic protein or molecule of interest constitutively or regulated.

In certain embodiments, the polypeptide of interest is a bi-specific, tri-specific or multi-specific polypeptide, e.g. a bi-specific antibody.

The host cells of the present disclosure can be employed in the production of large quantities of a molecule of interest in a shorter timeframe as compared to cells, e.g., non-TI cells, used in conventional cell culture methods. In certain embodiments, the host cells of the present disclosure can be employed for improved quality of the molecule of interest as compared to cells, e.g., non-TI cells, used in conventional cell culture methods. In certain embodiments, the host cells of the present disclosure can be used to enhance seed train stability by preventing chronic toxicity that can be caused by products that can cause cell stress and clonal instability over time. In certain embodiments, the host cells of the present disclosure can be used for the optimal expression of acutely toxic products.

In certain embodiments, the host cells and systems of the present disclosure can be used for cell culture process optimization and/or process development.

In certain embodiments, the host cells of the present disclosure can be used for the constitutive expression of selected subunits of a therapeutic molecule and the regulated expression of other, different subunits of the same therapeutic molecule. In certain embodiments the therapeutic molecule can be a fusion protein. In certain embodiments, the host cells of the present disclosure can be used to understand the roles and effects of each antibody subunit in the expression and secretion of fully assembled antibody molecules.

In certain embodiments, the host cells of the present disclosure can be used as an investigational tool. In certain embodiments, the host cells of the present disclosure can be used as a diagnostic tool to map out the root causes of low protein expression for problematic molecules in various cells. In certain embodiments, the host cells of the present disclosure can be used to directly link an observed phenomenon or cellular behavior to the transgene expression in the cells. The host cell of the present disclosure can also be used to demonstrate whether or not an observed behavior is reversible in the cells. In certain embodiments, the host cells of the present disclosure can be exploited to identify and mitigate problems with respect to transgene(s) transcription and expression in cells.

In certain embodiments, the host cells of the present disclosure can be used for swapping transgene subunits, such as but not limited to, HC and LC subunits of an antibody, of a difficult-to-express molecule with that of an average molecule in the system to identify the problematic subunit(s). In certain embodiments, amino acid sequence analysis can then be used to narrow down and focus on the amino acid residues or regions that might be responsible for low protein expression.

EXAMPLES

Materials and Methods

Cell Culture

Stable cell line development was performed by targeted integration of antibody-encoding cassettes into a host cell line derived from the CHO-K1 line (Crawford Y. et al., Biotechnol Prog 2013, 29, 1307-1315). Cells were cultured in a proprietary medium at 37° C. and 5% $CO_2$ in either 125 mL shake flasks at 150 rpm or in 50 mL tubespin bioreactors at 225 rpm. Cultured cells were passaged every 3-4 days at a seeding density of $4 \times 10^5$ cells/mL.

PCR Reaction to Determine Vector Configuration of Molecule-X Expressing RCTI Clones Genomic DNA was extracted from $2 \times 10^6$ cells using a DNeasy Blood and Tissue kit (cat# 69506, Qiagen), and PCR was performed using a LongAmp Taq master mix (cat# M0287, New England Biolabs). Thermocycling parameters: 94° C. for 3 min, 40 X (94° C. 30 sec, 60° C. for 1 min, and 65° C. for 9.75 min), and 65° C. for 20 min. Diagnostic digests of PCR products were performed with enzymes from New England Biolabs. The following primers were used for PCR: Forward primer: GGTTCTCCTTGAC-CAATACCTCGTAAG; Reverse primer: GCGGGAC-TATGGTTGCTGACTAAT.

Shake Flask Fed-Batch and Ambr™ Bioreactor Production Assays

Fed-batch evaluation of monoclonal antibody A ("mAb A") and Molecule-Z expressing clones was performed in shake flasks using a proprietary chemically defined medium in a 14-day production process. Cells were seeded at $1\times10^6$ cells/mL on day 0, cultures were temperature shifted from 37° C. to 35° C. on day 3, and bolus feeds consisting of a proprietary blend of chemically defined components were added on days 3, 7, and 10. Viability and viable cell counts were measured with a Vi-Cell XR (Beckman Coulter), and lactate and glucose levels were assayed using a Nova BioProfile 400 (Nova Biomedical).

For evaluation of Molecule-Y expressing clones, a 14-day production culture was performed in Ambr™ system (Sartorius) as described (Hsu, W. T. et al., Cytotechnology 2012, 64, 667-678), with the following modifications: Inoculum trains were seeded at $1\times10^6$ cells/mL in shake flasks for 4 days at 37° C. and 150 rpm. Production cultures were inoculated at $2\times10^6$ cells/mL and initially maintained at 36° C., followed by a temperature shift to 35° C. on day 6. Bolus feeds consisting of proprietary blends of chemically defined components were added on days 3, 6, 8, and 10. Viability and cell counts were measured on a BioProfile Flex2 (Nova Biomedical). pH, pO2, pCO2, glucose, lactate, and other metabolites were assayed on either a BioProfile Flex2 (Nova Biomedical) or an ABL90 Flex (Radiometer).

Analytical Assays for Titer and Product Quality

Titers were determined using protein-A affinity chromatography with UV detection. Size and charge variants were measured via protein A PhyTip purification (PhyNexus) followed by size exclusion chromatography and imaged capillary isoelectric focusing (icIEF), respectively. Phytip-purified samples were treated with carboxypeptidase B prior to analysis by icIEF. For Molecule-Y, liquid chromatography-mass spectrometry (LC-MS) was used to quantify relative quantities of correctly assembled heterodimer, homodimer, half-antibody, and light chain mis-paired species, as described (Williams, A. J. et al., Ind Eng Chem Res 2017, 56, 1713-1722).

Comparison of Current Transfection (TFX) Strategy Versus TFX Strategy for RCTI

Figure 11A:
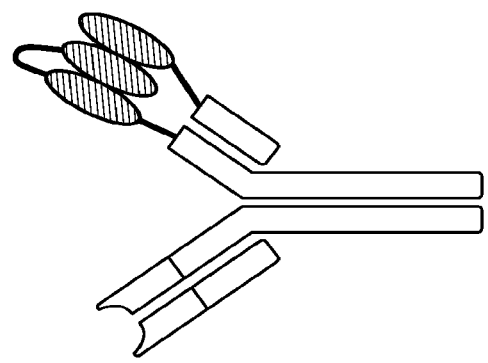
FIGS. 11A-11C are schematics illustrating exemplary molecules expressed by methods of the present disclosure.

Stable cell lines producing monoclonal antibody A ("mAb A") (FIG. 11A) were generated using a "Randomized Configuration Targeted Integration" (also referred to herein as "Randomized Chain Targeted Integration") approach. In this approach, host cells were transfected using a library of three "front" and three "back" expression vectors, each containing one of three possible combinations of mAb A heavy chain or light chain sequence repeats. As used in the instant example, references to "front" and "back" expression vectors refer to upstream (front) and downstream (back) cassette sites in the context of a two vector RCME-based introduction of exogenous sequences of interest. See, e.g., Section 5.1, above, for additional detail with respect to two vector RCME-based strategies. Top clones produced 3.4-4.7 g/L titer and were selected based on titer, productivity, cell culture performance, product quality, and flow cytometry population heterogeneity.

Compared to previous Cell Line Development (CLD) efforts for mAb A, the RCTI CLD method described herein produced clones with comparable titer, product quality, and production culture performance to that of clones produced by the standard CLD method, while screening fewer clones in fewer CLD cycles.

Previous CLD efforts for mAb A have tested individual combinations of front and back vectors in independent standard CLD method workflows (See FIG. 2A). In total, 7 combinations of front and back vector configurations were transfected and evaluated through pool production. Of these 7 vector combinations, four were moved forward for SCC and clone evaluation based on pool production titers. Thus, four independent CLD cycles were performed, along with three additional partial CLD cycles, in which three additional vector combinations were transfected and evaluated through pool production.

In comparison, a single CLD cycle was performed for the RCTI CLD method. Table 1 summarizes the number of clones assessed for each method, and FIGS. 2A and 2B illustrates a comparison of the RCTI and standard CLD workflows for mAb A clone evaluation.

TABLE 1

Summary of Clones Screened for Standard versus RCTI CLD

|  | Standard CLD | RCTI CLD |
|---|---|---|
| CLD Cycles Performed | 4+ [a] | 1 |
| Clones Picked from SCC | 4,224 | 704 |
| Clones Evaluated in Production Assay | 120 | 24 |

[a] For the standard CLD method, 4 independent CLD cycles were performed simultaneously, along with three additional partial CLD cycles, in which three additional vector combinations were transfected and evaluated through pool production.

For the RCTI CLD method, three experimental arms were evaluated, corresponding to transfected pools at three stages of recovery: (i) early (day 5 after transfection, sorted into selective media), (ii) mid (clones recovered to approximately 35% viability after selection), or (iii) full (clones recovered to >90% viability after selection) (See FIG. 6A). For the purposes of comparing the RCTI CLD method to the standard CLD method, only clones from the third arm (clones recovered to >90% viability after selection) will be discussed in this section, as the standard CLD specifies SCC for pools at >90% viability. For both the standard CLD and RCTI methods, one CLD cycle is defined as the entire process from transfection through clone production culture assessment.

For previous mAb A CLD efforts, a large percentage of the highest titer clones also exhibited high aggregate, or % HMWS above 10-15%. Therefore, in comparing clones produced by the standard CLD method versus the RCTI method, both titer and % HMWS were considered in selecting top RCTI CLD clones. For the clones produced by the standard CLD method, the distribution of % HMWS roughly clustered with front and back vector configuration for some configurations (FIG. 3B). For example, clones with the C-2 configuration (FIG. 3A) generally produced lower % HMWS whereas clones with the B-2 configuration (FIG. 3A) produced higher % HMWS.

For the RCTI clones, the ranges of titer and % HMWS were comparable to that produced by the standard CLD clones (FIG. 3B), although far fewer clones were screened. As the RCTI method involves transfection of a random library of front and back DNA vectors, long-range PCR was used to determine the front vector configurations for the clones evaluated in production culture. Although 3 of the 24 clones had inconclusive long-range PCR results, the remainder of the clones clustered similarly in terms of front vector configuration and % HMWS profile when compared to the standard CLD clones. The majority of clones with the C front vector configuration showed lower % HMWS than clones with the B configuration, and clones with the A front configuration spanned across the range of % HMWS. Determination of the back vector configuration was not necessary here because % HMWS levels correlate directly with the front vector configuration only. The highest day 14 titers for the RCTI clones were also comparable to that of the standard CLD clones (≥4.5 g/L). Note that if only the B-2 (FIG. 3A) or A-1 (FIG. 3A) configurations had been tested in a standard CLD approach, few clones, if any, with a combination of high titer and low aggregate could be obtained.

Growth, productivity, and other product quality attributes were also comparable between the standard CLD and RCTI CLD methods. FIG. 5 summarizes the distribution of various attributes across all of the clones evaluated in production culture for both CLD methods. Similarly, the top clones from the RCTI CLD method performed comparably in production culture to the top clones produced by the standard CLD method. Of the configurations tested in the standard CLD method, only the A-2 and C-2 configurations gave high titers (≥3.6 g/L) while producing low aggregate (% HMWS≤15.4%). Clones obtained from the RCTI approach have similar aggregation and titer ranges as those obtained in the standard CLD approach. While representative high producing clones from the RCTI approach appear to be in the C configuration in Table 2, as illustrated in FIG. 3B, high titer and low aggregate clones from configuration A were also seen, although they did not rank amongst the highest-producing clones. Table 2 compares titer, growth, and product quality attributes for the top clones according to the standard and RCTI CLD approaches.

TABLE 2

Comparison of top mAb A clones produced using standard CLD and RCTI CLD

| Config. | D14 Titer (g/L) | D14 IVCC | HMWS (%) | Acidics (%) | Man5 (%) | D14 Viability (%) |
|---|---|---|---|---|---|---|
| Standard CLD Method Clones | | | | | | |
| A-2 | 4.5 | 994 | 15.4 | 33.7 | 0.9 | 96.2 |
| A-2 | 4.2 | 939 | 14.1 | 32.0 | 0.6 | 96.0 |
| A-2 | 3.9 | 1007 | 5.7 | 30.7 | 0.4 | 96.3 |
| A-2 | 3.9 | 1386 | 7.4 | 29.8 | 0.4 | 97.7 |
| A-2 | 3.6 | 1302 | 6.8 | 31.3 | 0.5 | 96.1 |
| C-2 | 4.0 | 1262 | 7.1 | 34.6 | 0.7 | 93.2 |
| RCTI CLD Method Clones[a] | | | | | | |
| C | 4.0 | 1782.4 | 10.9 | 29.6 | 0.4 | 94.4 |
| C | 4.0 | 1595.8 | 8.6 | 35.0 | 0.4 | 93.1 |
| C | 4.7 | 1875.0 | 11.4 | 34.7 | 0.5 | 93.8 |
| C | 3.4 | 1463.1 | 5.9 | 31.6 | 0.3 | 91.7 |

[a]For the RCTI clones, only top clones from the third experimental arm (SCC after recovery to >90% after pool selection) are considered for this comparison.

Compared to previous CLD efforts for mAb A, which used the standard CLD method, the RCTI method offers a number of advantages. First, a single RCTI CLD cycle can be used to screen the same number, if not more, vector configurations than the standard CLD cycle while using fewer resources. For mAb A, the standard CLD method required 4+ CLD cycles to screen 7 of the 9 possible vector configuration combinations whereas the RCTI method screened all 9 combinations in one CLD cycle. Fewer individual clones can be screened as well. Across all standard CLD cycles for mAb A, a total of 4,224 clones were picked from SCC and narrowed down to 120 clones for screening in production culture. In comparison, a total of 704 clones were picked from SCC for the RCTI approach, and 24 clones were screened in production culture. Because of the reduction in CLD cycles and number of clones to screen, the RCTI method enables reduced labor requirements for CLD, including both a reduction in manual labor and the burden on automation resources to perform SCC, imaging, and hit picking. Last, despite the reduction in required CLD cycles and number of clones screened, the RCTI method produced clones with comparable distributions of titer, cell culture performance, and product quality as the standard CLD method. The top clones produced from both methods were also comparable.

Evaluation of RCTI CLD for Expression of a Bispecific Antibody

Figure 11B:
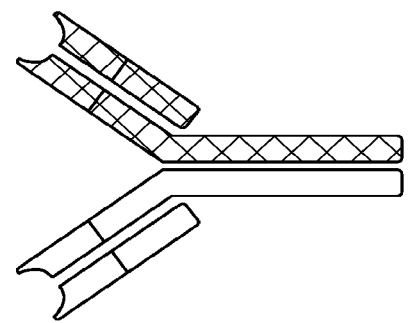

The RCTI approach was evaluated for the expression of a bispecific antibody ("Molecule-Y") for a disease indication with high clinical demands, thus requiring isolation of high titer cell lines during clone screening process. Expression of bispecific antibodies in a single host can result in assembly of unwanted byproducts such as homodimers and heterodimer heavy chains with common or mismatched light chain species (Dillon M. et al., mAbs 2017, 9, 213-230; Carter, P. J., Experimental cell research 2011, 317, 1261-1269). Therefore, a critical step during bispecific antibody clone evaluation is isolation of clones that not only have high total titer, but also high effective titer (the desired bispecific antibody species) with lowest levels of byproduct(s) that are difficult to purify away from the target bispecific antibody. For Molecule-Y (FIG. 11B), the most challenging byproduct to purify away was the heterodimer heavy chain with common light chain species (herein referred to as "common-LC BsAb"). Therefore, during standard TI CLD process, four different vector configurations were used in parallel CLD attempts and during pool production evaluation prior to SCC, mass spectrometry was used to measure common-LC BsAb and effective titer levels. Pools with lowest levels of common-LC BsAb were chosen for SCC and the top 62 clones with highest titers and lowest levels of common-LC BsAb were then evaluated in a production assay (FIG. 7A, squares) for standard TI CLD approach.

Figure 7B:
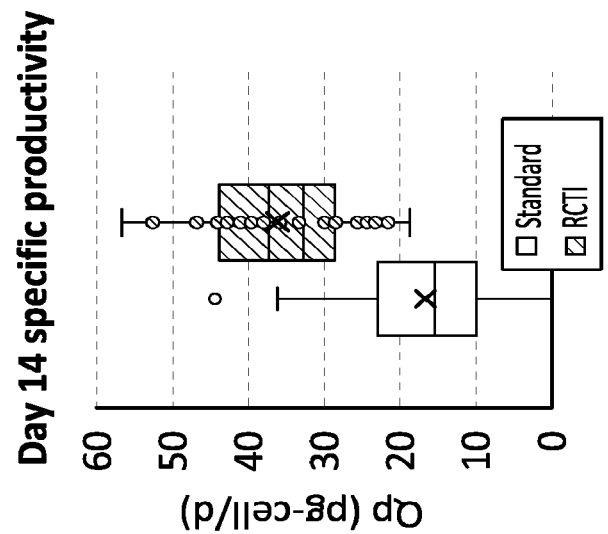
FIGS. 7A-7B depict titer is comparable between standard CLD and RCTI approaches for Molecule-Y, however specific productivity of clones from RCTI approach are higher than that of standard CLD.
Figure 7A:
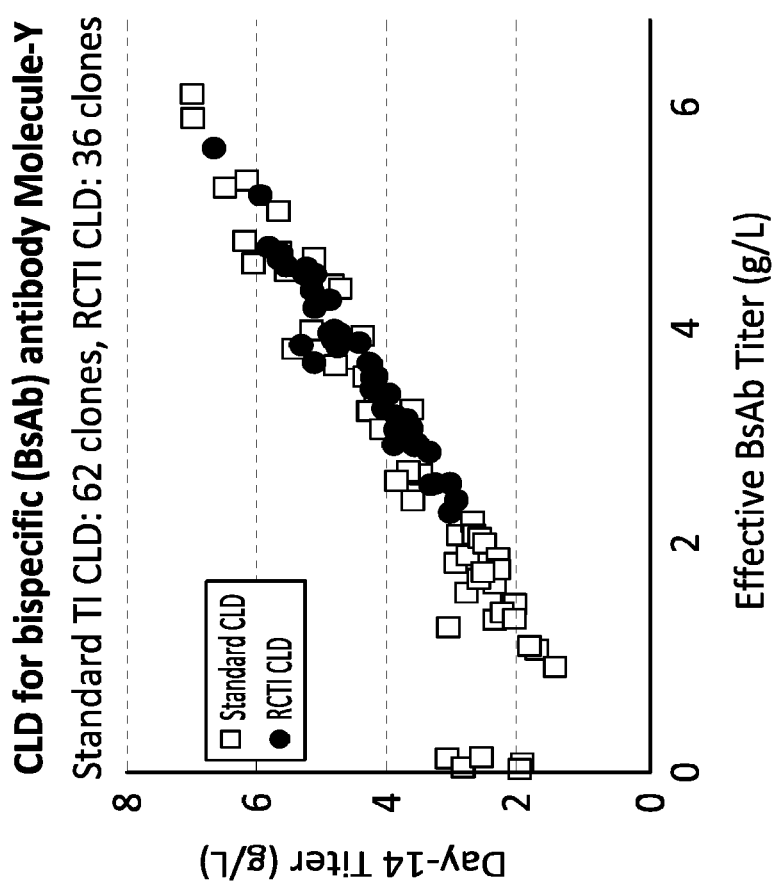
Figure 9B:
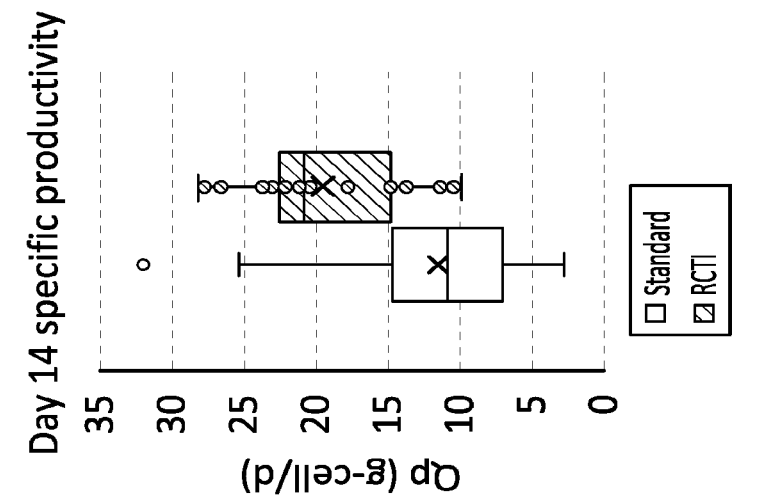
FIGS. 9A-9B depict titer is comparable between standard CLD and RCTI approaches for Molecule-Z, however specific productivity of clones from RCTI approach are higher than that of standard CLD.
Figure 9A:
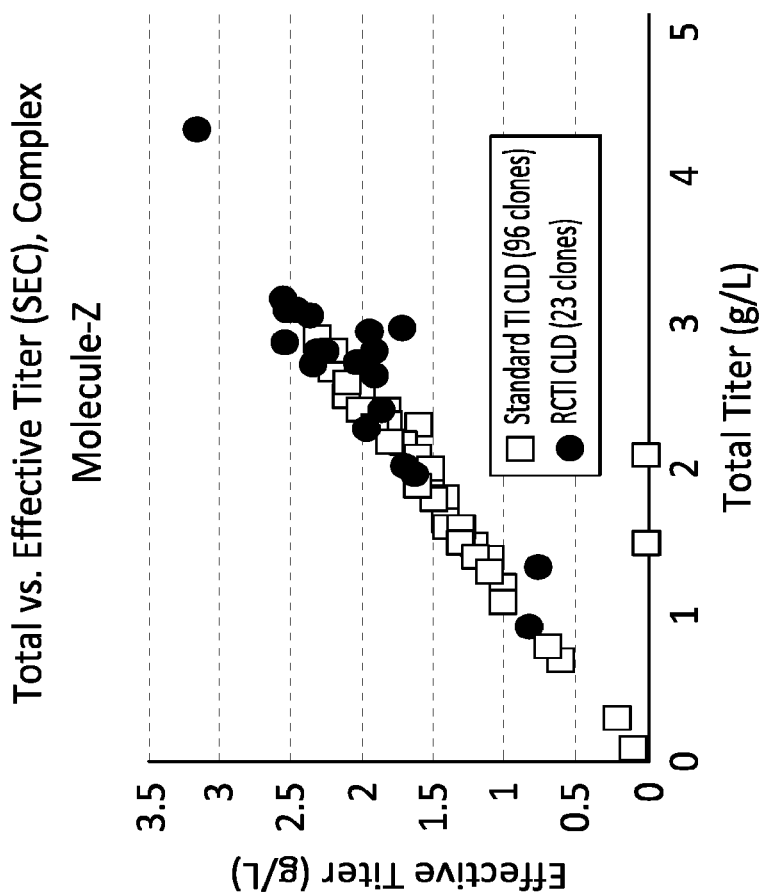
Figure 11C:
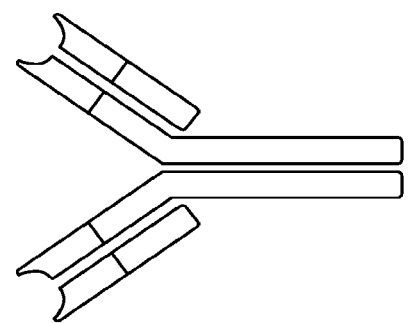

Since we previously established that in RCTI CLD approach recovered pools still maintain vector configuration heterogeneity (FIGS. 6B and 6C), for RCTI CLD of Molecule-Y all four vector configurations were used to transfect the TI host and SCC was performed only after full pool recovery. Additionally, clones were ranked only based on their effective titer, using rapid-fire mass spectrometry, during early screening steps. During this process, levels of common-LC BsAb or other individual byproducts were not considered for clone selection. Based on these criteria, the top 36 RCTI clones were then evaluated in production assay (FIG. 7A, circles). Despite evaluating only half as many clones in production assay, from RCTI CLD approach clones with comparably high total (~6 g/L) and effective (4-5.5 g/L) titers, relative to the standard TI CLD clones, could be isolated (FIG. 7A). Additionally, RCTI clones had overall better specific productivity (FIG. 7B), better viability (FIG. 8A) and slightly lower growth (FIG. 8B) profiles compared to the standard TI clones. Since it is easier to improve culture growth with process optimization, Molecule-Y expressing RCTI clones could potentially have even higher total and effective titers than their standard TI clone counterparts. RCTI clones also had very low (~5% or less) common-LC BsAb byproduct, which is approximately as low as those observed for the standard TI clones (FIG. 8C). Albeit, the standard TI clones are expected to have an overall lower common-LC BsAb byproduct as they were screened for this trait prior to evaluation in production culture. Product quality was comparable or better for RCTI clones compared to their standard TI counterparts. Molecule-Y expressing RCTI clones also had relatively lower aggregates (FIG. 8D), lower % acidic species (FIG. 8E), and higher % main species (FIG. 8F) relative to the standard TI clones, which are all more desirable product quality parameters. Levels of % basic species were relatively comparable between the clones isolated from either approach (FIG. 8G). Evaluation of RCTI CLD for Expression of a Complex Chimeric Antibody/Ligand Molecule Many upcoming therapeutic molecules for various disease indications are no longer just conventional antibodies but they rather have more complex structures and hence are more challenging to express. Expression of one such complex molecule ("Molecule-Z") in the standard TI approach required parallel CLD efforts using six different vector configurations followed by screening 96 different clones in production culture in order to obtain clones with high effective titers. (FIG. 9A, squares). Molecule-Z, which comprises a half antibody complexed with an Fc-fused ligand (FIG. 11C), was hence considered a challenging molecule to express and we decided to test its expression using RCTI CLD approach. Using the mixture of all six different vector configurations to transfect the TI host cells and select them in a single pool followed by SCC, evaluation of only 23 RCTI clones in production assay resulted in isolation of clones with comparable titer and product quality as the top clones isolated from the standard TI CLD approach (FIG. 9A). RCTI clones had higher overall specific productivity (FIG. 9B), comparable viability (FIG. 10A), slightly lower growth (FIG. 10B), and lower overall % aggregates (FIG. 10C) compared to the standard TI clones. Because of having significantly higher specific productivity (~2 folds higher, FIG. 9B), RCTI clones can potentially achieve even higher effective titers if cell growth is further increased via process optimizations. Finally, RCTI clones had comparable % acidic (FIG. 10D), % main (FIG. 10E), and % basic (FIG. 10F), charge variant species to standard TI clones. Altogether, these data support the notion that RCTI approach can be used to isolate clones with comparable titers and product quality attributes to the standard TI approach, but with significantly fewer resources and efforts.

The preceding examples are merely illustrative of the presently disclosed subject matter and should not be considered as limiting in any way.

In addition to the various embodiments depicted and claimed, the disclosed subject matter is also directed to other embodiments having other combinations of the features disclosed and claimed herein. As such, the particular features presented herein can be combined with each other in other manners within the scope of the disclosed subject matter such that the disclosed subject matter includes any suitable combination of the features disclosed herein. The foregoing description of specific embodiments of the disclosed subject matter has been presented for purposes of illustration and description. It is not intended to be exhaustive or to limit the disclosed subject matter to those embodiments disclosed.

It will be apparent to those skilled in the art that various modifications and variations can be made in the compositions and methods of the disclosed subject matter without departing from the spirit or scope of the disclosed subject matter. Thus, it is intended that the disclosed subject matter include modifications and variations that are within the scope of the appended claims and their equivalents.

Various publications, patents and patent applications are cited herein, the contents of which are hereby incorporated by reference in their entireties.

SEQUENCE LISTING (12 sequences)

SEQ ID NO: 1 - DNA, 3974 bp, Cricetulus griseus
cgcgacaccgattctcactctcatttggagttgggctctgagataatccaatcactgtcgctctggtttgtaaatttgcccaagatctgcccagaaccagactctcagtgtccccaaggatgggggccactgtgcaccctgctctcctcctgctgcttgcagaccctgtgttctgggctccaacccgcgcaggtgagtgccacccaggggaaaaatggcctcggcggcaaggggtgggggcggcacccgggaagccgcatcttccaaactctcagccagaactttcagatccattctccacctgcatccctagacccgtgccctgctcccttaccagcccggtgcacctgccaagaggtgcgggtctcaccgctcaccgcccccaggctcacactcgctgctgtatttctacaccaccgtgtcccggcccggcctcggggatccccggttcattttcgtgggctacgtggacgacacgcagttcgtgcgcttcgacagcgacgcggagacgcccagagtggagccctgtgtagggtggatggaacaggagaggcctgagtattgggagctgcagacccagatggcctggactcaagcaaagctgtccggtgggagcctgatgaccctgcttcgctatttcaaccagagcaaggacggtgagtgacccagacactttgggagcaccaaggttgtccagattcactggactggagtatcaccctagacctgcccggttcgttaagcagaaaagggcccgcagggattcgcttggacttggtctgaagttagtggtgctgcgcttcctaagagggctgaccaccttgtccccgctagactctcacacgctgcaggggatgcgtggttgcgacgtgggggcagatggacgcctgctccacgggtacaaccagctgggctatgatggagaagattacctcaccctgaacgaggacttgagctcctggacagcgaccttaggtcagatctctcagggcaagttaggagaccacttgaaggacagctgcgtggagacgctgcacaaacacctggaaaaagggaaggaagtgctgctgcgctcaggtgcccggggagccacaccccgcccaagtttccctctggctgcttgctgggagtttagagagctgggggtgcctgcatgggcaggatgagagcacttggggatagctcacaggttgagtgctgcccagcaggacaggttctgggttagagcctttccttttccggagggggaggagagggaggcaggtgaaccagagggccttagctcactcctccccagagtccaaggaggcaggagacaacttggttccaaatctttgaccaagaatgaatccctcagaggacagcccttctcttactgccagtaaagaaattcattttccctaacagtagaccaaccttttagtaactgatcaacagttcctttacttgggcaatggacctggacccataggaggttttttctctcaggcctcctccagtgtatctggagtctggatcctgcttttctgagtctcctggccctccctcagctcaggaccagaaaactcctcccatccatcagtctgcagagccctgaagccccctaccctagagcaccccaaagaacagattacccccagtgcctgctctacttggggtctattaatatatggacacctaatcccaccccagttctgctgtccattcctagaatggtcacatgaacactgctgagtccccaggaaaaagccagatgcctgatcttcccaactctccccctcagaccccccaaaggcacatgtgacccatcatcctggatataaaggtgatgtcaccctgaggtgctgggctctgggcttctatcctgctgagatttccctgacctggcagttggatggggaggacctgatccaggaaatggagtttgtggaaaccagaccagcaggggatggaaacttccagaagtgggcagccgtggtggtgccttctggggaggaacagaaatacacatgccatgtgcaccatgaggggctgcctgagcccctcaccctgagatggggtaaggaggaagtgggtgcagagctggaggcagctgtagtcagagcttagaactgggtggtcctcatctccccctcctttcccagagcctccttggaacaagaaatattggtttctcctccttatcctcatcctcatcacagtttgggtgctttgcatatgtaagaagaaggatgcaggtaggatgctgagtttacttgtcccactgagggcttcaagccataggtggcagtgtcctgcctaggtaatgggatgtaccatccacagctctgtgtctccttcatttgtgacctttttgtttaggcttcaaaagtagagaagggaagatttgcttgggggatggttctggtgactgagatctcatgtccagctgtcgcaagcagaggtctcactaaggacaaacctccaggaagctattacaatgtctcagttctcgaaatttcccttgggctagggactaaggttcccaaccctttggaggtcacattaagatatccttcgtatcagacttgcattatgattcatagaagcaaaatgacagttacgaagcagcaacacaataattttatggccggtggctcaccacagcatgaggagctgtgtttaagggtggcagcatgaggaagtgcctgctcccatgatacccatacatggatttctttcctcaggtgggagaggaaggagccacactcaggaagaaggtaagtgtggtgagaggtggtgtctgagactcttggagtccatgagagctcacccagcccatagtcccccctcaacctccagtcttctgaagcctgaccaggtcctgctctgttctttcctaggcaggaacagtggccaggactctggtgagacggccgtggatgatgaggtgatatgtggggaaagacagacgacacaggttggggctggagagagtctttgcactcagacatttagagtgaggaggaagctattcagaatgtcaccactataccgtgacatctgccttaatcttgtaggagatggtcattctctctggggagcctgagccctctcggaatcgtccagaccactccttcagactgagtgatctgtcattctgaaaaggtatctgattgtcctccctctactctgtggcactcagaagtctctgcttagtcttctcgctcagggacacccccacttccccgccctctcccacacccaactccatgtggaagtgcctggaacagctactacagaatggaatcttttgttttgttttggtgacagggtttctccatgattcagtcctggctgccctgtaactcactctgtagcccaggatggcctcgaacccacagagatccacctgcctctgcctgccaagtgctgggattaaaggcatgtgccaccaccatacagctcagaatggaatcttctgttttgtatatcaccagacatcttcacagtcaacttgactggacttagaatcacctagaagccgcccctctggatgtgtctgtgagggtgtttctagccaggtttaacccaggaggaagaaacaggttgactgtaaggtagcttcactcacagctggagtctgaagagaaagccagcaggacactggagtcccccttcctgtgtttcctaacaggacatgagcaggccatctcctgccaccatgaacagagacaggtcccacttttctgtcttgaacatctgacacctgtctcttccctaagtggcttctcatcaggtattttttgtcgcagggcacagggttagacacaaagctccttccccacatccaaggcttcctgagcatcactccctaatcttttagagactttcactcaggccaaactgggatctatggctttggtgcggaaaaggattatggactactagagctggtgtttaataaacatgtttctatttgtttttaattttaa

SEQ ID NO: 2 - DNA, 247881 bp, Cricetulus griseus
  misc_feature (27878)..(28464): n is a, c, g, or t
  misc_feature (32310)..(32559): n is a, c, g, or t
  misc_feature (44725)..(44763): n is a, c, g, or t
  misc_feature (52911)..(52984): n is a, c, g, or t
  misc_feature (54132)..(54158): n is a, c, g, or t
  misc_feature (55328)..(55418): n is a, c, g, or t
  misc_feature (61688)..(61819): n is a, c, g, or t
  misc_feature (65710)..(65816): n is a, c, g, or t
  misc_feature (76404)..(76428): n is a, c, g, or t
  misc_feature (81914)..(82028): n is a, c, g, or t
  misc_feature (99280)..(99312): n is a, c, g, or t
  misc_feature (103366)..(104009): n is a, c, g, or t
  misc_feature (104456)..(105181): n is a, c, g, or t
  misc_feature (105312)..(105349): n is a, c, g, or t
  misc_feature (105697)..(105860): n is a, c, g, or t
  misc_feature (106069)..(106131): n is a, c, g, or t
  misc_feature (118030)..(118158): n is a, c, g, or t
  misc_feature (149844)..(150135): n is a, c, g, or t
  misc_feature (180498)..(180511): n is a, c, g, or t
  misc_feature (183367)..(183466): n is a, c, g, or t
  misc_feature (192091)..(192520): n is a, c, g, or t
  misc_feature (196828)..(197583): n is a, c, g, or t
  misc_feature (197889)..(197995): n is a, c, g, or t
  misc_feature (198807)..(198816): n is a, c, g, or t
  misc_feature (200258)..(200402): n is a, c, g, or t
  misc_feature (203405)..(203415): n is a, c, g, or t
  misc_feature (210100)..(210542): n is a, c, g, or t
atgaatctgagagtcagaagagacatgaaggctgcagacaaaattctgataagcatacaggtaagagttgaaaccatgagtatgtgtgataatatccagggaatgtgtaaaaaataaagaaaactacaaaagccaaactctgatgagtttcatgatttaagaaagtaaaagcaatccattgtcacaatgtgtgataagtaccacttaaaggcaaaaataagatactctagtgactcaaaataagattggctagcttgtgatgagatactgcatgaagggctttacttcaatttaagggatgtataggtgtgtgtggatggaattggggcaagaaaacaatcatctattttacaaggaaaacaaaggacttcaaatgaaaaaattctcaagcatccttcagctgtatatcctagtatatgggcagtgttcctcaaagtgtggtcaacagttcactggcatgagagactcacataaggcatttatcaaaacaaatactatattaaattttgtgcaaagtaattgaaggtgtgaccttggaagaagcagctagagtgaagtgggcctaaaggctttggagttgatgagttcaaaaaattggaatcttaaatttgccagcattagcagggaggaagtgggaaatgaagtgtttgtagattgggatgttttgcaagaatataattgacttcataggttttgctttacttaagctgaaaaatgagccaaacatgactaagacgagtagctatcctctaagctggtcccaagttacccaggacatacacaaggtcaactccgtgaaagaaaaatgaacacttgatttggttgactgggtgtggtcattaaaacactaatgacaaaaacacagccatgaattaccctgggtttgctttcacttttttagcttgttatctgacactttatcagcctttcctaatgaactgatactacctaaaattaccaagtgtttgctttacaattcattaataatattggagataaaaatttccatgtttccttaatttttatcctaaaaaagatttgtttttaatttgcctgtttgttttctaaagatagggagaaaggtggcatgaagttagatgaacagagaagtagagaggatttgagagaagatgggagagggaaaacagagatcagaatatattgtatgaaaaaataattttgataaaaaggaattttttttaaaaaagaaagctactgttaagtaagaaaaagtgtttaaagaaagatacatcagggttggaaaaatggctcagcagttgagagcactggctctccgggggaccagggttcatttcccagcacccacatggcagctcataactgcctatgattccagtttcagggaatccaacaacttcacacaggcatacatgcaggcaaaacatgaatgcacatgaaatcaaaagggagggttggtggagggtgagagaggagagagggagagggagctgggattgacatgtgaagcaagcttgttgttaattttaaaaaataataataaagaaaccattaagaaaaaagaaagatacatcatgataagtttagaaatgccttgcttgaagggacatcatgaactaggtaaaccatgaattaatcttttgtctttatggaatcacagggctttgctttcacattaaattgatggcatacatacatacatacatacatacatacatacatacatacatacatacatacatacatacataatacatacatatatcctactgtgatgagaatccttcttctgagtaatctgttaatgcgctttgttactgtgtcaaagaatctatctatatgaccttccagagttgggcacatcaggttagaatcatggcatcaaactttcttaccttttggtttcagaataagtccaatgttcttagtcatcccctgtaacttctctgggaaaaaagatatataaacaattgtcctcttcaaagctagtattatacctggccctttcctgagatacgattaatttagttcttacttcaaaacagaacataaagaatgataaaaatttcattaaagaactagctcttctcttcacagatatattaattttgtttataattcaatgttttctaacataaattttctggaccacatattgtgttattaagttagtaatgaatgcgaagcagatggcatagcctccattaaccaggaattagaaggctttctaggacatgtaagaggtataaaagggaaaataagctgtcacttatgttgtaatacttttggttggtcgctatatgagatgagaaattcttgaagaaaaagaaagaaagagcagtaagaaggaagaaaggaattgaaataagaaaaaccaagcaaaaagaaaagaaaaaagggaggaagagcctcgaaacttaaaggaaaacctttaagttttgcacagttctacagggaaagacactaaagcaatgaaacactgggccactagagagttacatttttctggaacgtatactaatattcctataggaccatgacatttattttgtattagaaaatattacatttactaaaactaccttgcagtgattttattagtttagcctgctattgtattaactgctagcgctccccagaatgttccatgaagtgggtgacttaaaaaatagataattattttctaacaattctgaggggtaaaagttcaatgtcaagcagtatggcttccttctaaagcctatgtccctaacttccagataactgtctccttgtgacttcacaaagtctttctctgtatgtcctaattttctcttcttataaaaacacaagtcataattgatttggaccccttattttaacttaattacctcttaaaaggccccatctttaaatactgtcatatttttaaataggatttcaacatgaattttggcagaaactgtttaacacataacacttattacttcagattttcacatacattaacacaaaattccatatatgcatacataatgcaattttaaatgtatttatttacttgtgtgtatctacttatcctgtgtgcacatacatacaccatggtgtgtgtatggaggtgataggacagctattccaagtcaattctcaccttctacctattgaagatgggtctcttatttctgtcacactacgtactccaagccatctggcccattcccttccaagcaattttcctggctcgtctgcccattttaccaatttccctgcctcctctacccatttcaccttacgagtgttcggcttgccaatgtacacaaccacatctgaattgctgtgagtctggggattaagtagtcaggctattacagctattgctcataatatcaatttgtgagttaccattttataggttttatccagctgagcctggtggcatatgattttaaccacagcatttaggaggcagaggcagggagatatctgtgagtacagtgccagacagggcttcatagacactctgtctcaaaataagtaaacaaacaaataaataaacaaacctgccctttaaaataaaggtctattccacgggaggaatccatgagcatgttctattgcccatgctttcctaggtacttaagtaggtgttatggctaaaatgaaaaaaaaaaaaaaattttgtttcccttgaagacttttgagatcagaaagaatagaaatagcataaataagcaagcacaataaaatgtattaaatactgctaaaggaagaaacgaagttttgaaagccaaatttagttagacccatagcaagccagcaaaggtgaagcaatatattagttacagaatattgctgtgctggctcttttttttttatcaactttatgcagagtcgcctgggaagagggaacctcaactgaggaatggcttccatcagattgccctttgggcgagcctgtggaggcattttcttgattaattattgatgtgggagggcccatcccactggtactttgccacccctggcaagaggtactgagttatttaagaaacactgaacaaagccacagggggcaagccagttaagcaacacccatggcctctgcaccagctcctaccaccaggttcctgccctgtttgagttcctgctctgactttctccaggaatgggctgtaaagtgaaagctcaaataaacccttttctccccaagttgcttttggtgaatactttatcacaacaacaggaaagtaaactacaactaattatcgacctaattaacaccactacataaagtattaggtcattattttttgtaatatgtaatttattcatccatttagcttttattctgaaatttgaaaaaccacttactatagatattgaataaaatatattataaaatactatgttccaatttgtcaaaaagtctatagaaatatattagttttagcatgaaagatggtcatgatttgattttgcataatatgttacccaaattaaaaataatcctgatagtatactagaagttaagctatcattatacacagggatatgtataggtgtgggggtggagggtaaaagagagagtgtgtgtactcagaattctaaggactgctcaaaaaattatgcatgagttgtttgccaagaactataacatatcccctaaagatatgcaacaaccaaacaaccatagaaaaaaatgtggtgagttaacacaattcattatcaagtcctatatcatttagatagcattatttatcttaaaagtttatcttgatattatgatgcacttcaagaagcatttagttcagcttagttatttttataaagtcacatttttcctgacccctgaggataaacatatcataaagactcacatacaccagtgattcttaactttaagtttcttttctctttggtctttcaaagacattcatagaagtggaaagaggagttttttgatcactgtaaacaccatcatgaaatcaaggaaagaatcctgtttgttgttgtaatagactcaaaatagtagtctttgtataacaaattaagagaaatatgacataaggaaatatgacttaaggacagaattgttaagagctaaagatcttagttcataaactatagacagacagacagacagacagacagacagacagacagacagaattagaatggcctacaggctgtggtgaatgttgggtttttagttaatttctgatgcagtcaatttgacagacaataaaagccatcacatctatgtaatacaaacattacacaagacttctgaaatgaccatttataatatgcaacaagctctgtaagaaaaactactttgttttatagctacttaatatattcttttaaaactgtgatataattaatataccataactctttcaaaaatatgtagctcagaagccagtaagcaggctcagcaggtataggtgcttgctgctaagcctgaaaacctgagttttattcccagaacccatgtgatggaaattgtcttaggatctccacacattaccctacccagcaacacaaataaacaaacaaataactaggtaaatgtgtatatcaataactgtatagtttgactatattcacaatgttataaaactatctccactctaaactgccagtacatattacattaacaataaataaataaataaataaataaagcatttcttttacctactcagaatacttgaaagattgatgagtctttgcttttactaatttgccacttctggacatttcttataaatggaatcataatttgtcactctgttattggttccctatacttagtgcaatgtgttcaaatgagtcaatttttttgttttgttttttgttttttgagacagggtttctctgtggctttgcaggctgtcctagaactagctcttgtagagcaggctggtctggaactcaatgatattctagttaattgtcatagtgcattttgcttatccatatataaattggtgaacacttggattgttttgtctgttggctactatgaacaatgttttagttttcaatggtgtttttctgaaatggcaaaagtatttcactttggtaaagttgagttcatctatttatttttcaacattgtcctttgatgcttatatagaaaaaccaatatcgagaacattacatgtaagccaggcttggtagcacacacctttaattctagcactctgcaggcagaggcaggctgatctctttgaatttgagcccagcctggtctacatatggaattctggtacagtcaagactacatagagaaaccctctcccacacatacaaacaagaacattaaatctatattttatcccaggtgtgctatacattagattttcatttggtcttttgatttacttagagttactttttgtatattgtataaaatatgtatgggcccttctatatttgtcttggtcaataaaactttatactaaatgttgaaatcaagaagttaacaaaagtctaacccttttctagcaattactattcagcactatgaattgtcattccagtctatactactcagcatcagaaaaagaaatgaaaagcaaccaggttgcaaaggatgaagtaaaattgtcttttttttcttgcagaagacatgattttgtatatagataatctaaaagcatctacaaagaagctactagacttcaaaaggggggttagccaagctgcaagaatcaagaatcaattcatttcaataactggaatgtatttctatagtctaggaatgaacaattgaatactacctttttaacttttattgattctttgcagtttttacatcatgcattcccatccctcttatccactgatatctaccctctacccttgcaacctcccatcccctaaaacaaccaaaacccaaacaaaacaaaagaaaggagaagaatcttgtggaagatgtagtatggcctattgagtcacacagtttaccctttagtccattcatctttacttgcaagtgttcattgctaagagtcattggtctggctcaaggcctctggcttctactatgccactgataatggggatcctcttggatatcctgatctacagaatatgacatttaaaatgttttaataacataggtatttttaatgacaatgagaaatgttttctcctgacggcaccaatgtacttcagagaagatgataggaattgaagaaacttcacatggattcaccaagataggataggatagaaggtgtagttccatgtaggttccccagctgtcagtccatagtccttgaactcccattagcttgggtcagctgtctctgtggttttcccccctcatgctcttgacacccccccattcatattatccctcccccctctcttcaactgtacttcaggagctcagcccagtccttggctgtgtgtcactgcctctgcttctttcatagactctttaagtcatttattcacttcctccttaaaggcttctataatatgcataagggttactttaaggactttgtcttattcttctgctatgttgcaatactcagactctactgtggtagagtcgctgggctccagtggagacatattgtcttaactgttattgatttgtgtttgtgctggtgtcttggcatctgggtttggaagattgaaattcccgaggtgatgatatgtggtcttatctttgttgggtgttttccacgctggtttctgctttcctctctgcttcctaggaaggtgttgagactgtgtgttgcctgataggagattcttttgggatcccgctaggtacagtggggtttcctggtaaaatgtgtttctaggtattgggagctgattcttaggaatggggattgtctggggtagtggcaagggggttcacaggaggaaggaaaacagggtgttccaccaggatctgcttagtcccctgggaatgtgggaaaagagtgagaagaggccacaacaggtagtgtgctacagaattgttgatgaaactaagggataggatatggagaaagtaagagaatggtgaaggtctgcagttagtcttttccccctacctggactggccttcaggtttccaaggaatgcttattgggattaggcactgggataaagcaatgagctgggaaaagaaaggcttgaggggaagatctgtgtgttccactagagatgggggcagggaggtaggtgaggatacagcagatggcctgctacagagcaaaaggaaaattggatttggagcagaggatctgtagttattttccctcccttgatctgaatggcctgcaggttccaggtgaatgcccattggaattgggggctgggataaagtaatgagtgggggtcagaaatttggaagtgaagatctgtgtgatccattgacgatggcaggcctgggacattgctgtatgggttctgctgcaaggctggggataagactggggtattggatttgagggtgtggaggaagaagaaagcttcggcagttagcttgtcttcgttcctggcctgtatgccaaatttaaaagtaaataaaaagaaaaattgtaaagctttaaaaattaaaaacaaaacatttgagggaatgaaacgtaacagcattcataatgtgcttgttatatgccaagtactttagcaagagctttgcaaaggacagtagttgcatcattccatagcctcattttatttgtgggggaaactaaggcactgtagagatcagttacttgggtaatgccacaaggctgcaataaatcataacatatacttcatctcacaataattattgaaacatattagtcggtttttgtatcttagttaatattttatatacactacattatgtgatcccgatgactacaataaagtaggtaccacttcacagaggaagaaacatgattaagcaatgtgccccaaatcaggcatcagacagaagaatgtatttgaatcaagaatctttatctgttagttgtgtcctggtgggaagatgactacaaactattttcagtttggaagttggatctttggtacatgcagtcagattggatcttttcacaatcaacaaaatgctatgtgcttgatgtccaatgcaggcttttgctatctgtattactattggtaacccaccagagatgaccactcagacatagtttataggcagttgaaagtctatattccaactggctgggaccacacccagctactccaggatctaggtgtgaccccaagtgtttagagcacatgagttttgaaggcaaattccatgtattggcatctagctcagcagctgcttgtggccgttgtggaagcaagtagtttaacagaagcttagataagcatgtagctggagagattccacacaaacaggcagttgaacagaaggtgtttaagttagctaggacatcctgacctttgttttgtagagttggattattttcattgggattattcatcaaagagacccaattctagttaaacctgaaatggtctcagcaagaatacaagatggagaaacctttccattgtcttgccctgtcacattatctttattatctctctctgccttgtcccatctgtccaaatgaatatgtagacaccaatgacacaccaaagacttcctcctagctcatcctccatagcatcaagcctggttggacaggtattatatagttttccaggtccttggctgcaaatatgtgggtctctaccagtcccaggtagcatcctctacaagatttcctctctcttcctccctctctctctctctcccttcctccctccctctctccctccctctctctctctgtctctctgtctgtctctgtctctctctgtctttgtctgtctgtctgtctgtctgtctctctctctctctctctctctcttcatttctttctttcactagaaggcctcttagtgaacatatgtgaagcatgacaaaggcttgtttacaaaccgtttgagtcagctttaaagctacctgcttcttatagattcatttctgttttctgttggcatgagaaattctgtgccgttgagggctacagatgagatgaaagttttataggcaatactccccatagatgcagagattacactgaatgccttgttctttttaacacccattcacatgatgctgagacaactgtaatgtgttcatctgctgcccttgaccctgctgcttttgcctctccctcatctgccagccgtgtgcattgttccactcctgagagtgcctgctggtttgcacttgattcatgtcttatatcatcaactctattctatgatcctgacttcactaaacatttggcttccctttccatgcaatgtattgctgcctgttaaatgtgcagtttggtacttttgaaatatctgcatgtaaaaactgttcttgaggaggcagtcagtagtagttttcaccttcttacttcaatcacatctccaccactagtgatttattcttctgtctgttcttttctctagccctctggcttatttgtttctgccttaaggagttttcaaacatcagtgcatcaaaatcatttggaagacttattgaaatccaaatttttttatctcactaaagttttcaatgtaacagtcttggttggtgcctatcttggttggtagaatgtttcctttgtaatcatgaagtcctggtttgatatccaattccacatagactcagacatggtcacacacacacacacacacacacacacctataatcccagtaatttcgaggaagagtctggaagatcagtttaaggtcatcctttgctacactgagagtttgaagccagtctgggggacatgagaccatgtctcaaaaatatttatttctgtggttgtagagatggctcggcagttaaaagaactgactttccattgtagagggcctgggttagatttctcatacccacatggcagttcacaatcatctgtaacattagtttcagaggatccaatgccctcttctaacagccacaggtaccaatcctgcacatggtacacagatacatatgcagacaaaacacccatatgtctagcatgaaataaaactttaaaaagagaattatttataacaaattttgatgtaatgctaatactttggttgacacggtatagtttgagaaccacagttctagaccaacattgttcatattaatcacctctttatttctgtggcttgttatgtagtccctttctgttggaatgttccaatgtgcaaagatggctagcatagctaagattcctcatcttttagggccacaggaaaaaagctctgaatgttccatcgccctccaagtcagtgtcactgaaaagttacaaactgaatgtactgtctagaatcaaaataaaggtctcgaacttatttccattgttcagcccactgtctaaatgtaagctgttcagctttctagaagtggccaggagaaaaaaaaactcagaaatataaaaagtaatctatttgaataagcaaaatcatttggctctcatactcatattccttgccgttattataatgaaaatatttctatttgtacatattggcagaagtaaaggattattgttgcagaatattcctttacactgtgtgaagatgtgtcacggagagtggtttaataaagggctggatggccaatagctagcgaggaagaggttaggcaggacttctggggacagaaaagactttgagaggaagaaaggcacagtggccagccagatgccaagggagtagaatgggcagtacagagtaaaaaggtaactaaaccatgtaaaagaatgcagatttcaaaatatgggttaatttaagtcataagcactacttaggagcaagcctgagctatggtggagctttcgtaattaataataagtctccaaatcatcatttgtgagctggctggcaggacagagaaagactcgttacagattattggtatttggatatgaatgtcttccaaaggcttctgttgtgcaggcttgcttagttcctgttatgtaacgataactctttccgcctgctgcctgagcctggctgccacaatcgggcccccaaacagcatacagagtcttatgttagttacaatgctgctagccaatgactaggatttctcataagctagctcagtcttaattatcaaccataactactaatctatatattttatagagacttatcttatctaggacgcaggccttatgtgtcctctcttcccagggctcacatggagacttccgtcattactacatttctcagaatcctccatgactcctagctccacctatcttgcttccctattggccaacagtgctttatttatcaaccaataagacaaacatacacagaaggacttcccccatcaatgttcagagcttggcctttgaagaagggaacctttaacataatcagtggattaattcatagatggattcataatgggaaggcttattaaactgttatagagactaagagatggagatgggttagagaaagtagctcactggagttgtactttgaaggctttatctgctccctgagccagtcctgtctctttctctgatttctgatgaccctttgctgtgtgggatttcttcctagtgttatgctttagcacctcaagcccacagcactggaaccagctagctgtgaagtgaaacttgtgaaactatggtccggaataatctttcccttctgaagttgttttgttcgggtattttacataccaatgagtaggtaacacaattatctcggtgtgtatctattcatgcactttgtgcattagttttaatggataaacacatatctaagaaggcttgaagctaatgtaatttataaagtacaaacctccagcactaaaagcattcttccagcacacaaatggaattttgggcccctgtgtattttctggcacattctaagtacaagctggaatttgattccctaaatgaatgttgaactacaatgtaaagctccctttcctatgtctgcctgttcataggccaacatcagaaaattatattacagaaaatggctaccaggtgtggccaaaaggggagaataataacatgtgctgaataaaggctagaagggagcaaagaaaggaaaggggaagactaatgatgaataccaagtatcctttgactgaagagattagactttcatatttggctgctgagctgcctcttaaacagtttccgaactgaagttctgagcaattttacctttggtttaattggatgcagtcttccaatgatacattattttgaaaacaccacaatctgctcactggcttctgtctttaatgttacccaaggcttcttccttttggacttttctgtgactactcttcttttaagttaatgaatagcttctgtgctatttcactgttttggataccatctcacacgtctgaatgtgggtgtttttgttgtctgtttacttgctttttagataaggccttactatgtcttccaggctgggctgtctcccaggctgggcttgaactctgcctgcacgcatccttgcacctctatcttaggaatgtctagggctgcttctgctaaccattacacccagtttacctgcacatgtgtgtgtttttccctcagcactcagccattcaatatcaaaaatatttctctttttagatttccaatctttgttattgtatcatggtaccaacatcttttccctcatccctggccatcattcagtattaaaatctcagactctatgatgagtaataaataatgttatgcattttccttagatgatttatttttcctatttacacttaaattcagctttttggagacttatttcttggttctcattaatctttacctcagtggttctcaatctgtgggtcgagaccccactggggtcaagagaccctttcacaggagtcacctaagaacatcagagaacacagatatttactttatgattcataaaagtagcaaaattacagttttgaagtagaaaaaacaaatactttgtggttgggggtcaccacagcatgtagaactatactaaagggtcccagcatcaggaaggttgagaaccactgctctccatgctattctttggtaactgtttttactcccatagcttcaaataatatttcttttccttttcttccccttgagacaggttctcactgtgttgccaggctggcattaagcctacagagaccagtctgcctctgttttctgagtagtaggattaaaagcatatgccactgtgcctggctcaagctaatcattttaatgactataaatcttcacccttttcttcaaatatcatctctttctcagaaattttttagaagcactgtacttaatttctaataaaatcttcatgaacatacctggcaggcatctgaaatgctgcttcttttctctataaaacttgacattctgttatttttacaaatgtatttctcctattagattcccagtctcatatttctactcttcctactacaggatattgaaatctcagaatctatccctttcgtcgtttatatcaggtctccaaattctgagaaacatctatattatttgttttttcccctttattttcttttctactgtcccagagcttggggtatttatgcctaggatgaaactacctaactgcctctggtatctaggaccaaccaatatagcagtttatctattaaccaataagattaaacgctacatgcatgtatgctgtttacattgattctctttccttaagatatattttctctttgtctagactccgttaggcaaatccatgtgaccacaaatgaagtgtaattgaaactttcattatttggacttttactatattttccccttagttattagtggtagattttatcttagttgatccttccagctccttatagccttcacagtcctggatatctgtcctgggtaatgtttctagagaacagcactcaagtttaacatgcacatttcccccactcaaaagactgtgacttttgaaagtggcatcctaacttaccttctcatctcagtttctgatttttttttttttgagataaggtttcatgtagcccaggctggcttcaaactccctgtgtagctgaggacagccttgaatttctgatcctcctgattctgcttcccacaagcagggattctagccatgtgcctccacatttatttttatctagttctgggcattgaacccagagccttgtgcatgttaggcaagcactctatggattggactgcatccccaaacctgcttcctcatttttcttaaacagaggtctctattgagtccatgaatatagaacaaattcaaaattcaggatcacatttcaagtctctctgacttggttccactgctcttccagctttatctctcactgcagcatctgtagaatactaacacagtccatattttttcttcatgctgctggtaatgctaattcctttgtcacaaacagtttcctctcattttaacatttggggtcatacacgtacctaggaggctagattctctctctacaaaagttgccagattcttagttcttttcttattgtatgacactataacattcttttataagtaattatgaatttgtcggttgccctgactagatagtaattccattgagaccattcccttatattcagcacattgccctggatatggatcattctcaacattcatttatatactattactgaattaaaatcacatatgtaaattctaatattctagataaaatcttattataattctacatggtagtaagcaagaaaaacaagtttgaaacaggaaaagcaatcgtctcataatttatatatcaaaccataggcccacatgcaggccggcaatgcaacaggaaaacatttttctgaggattttggaatcaagctcagcccagtaagcctttgaatttggccactaccgaagccaagcctcagaggcctttttattgtgtgaagcaacaacatgatgagggattaaaggatgaaaatgttgatgcaaatcagggttggttcatagagtttagaggcagggctgcctttaaaaaataagtgctgatggaatggcttgttagcctttctgttctcaaagcagcagaaggccaatgttacagatatatttgaaacaagaaagcatcaaatcaaatacagaggagcagtgtgtaaatatcctggtgtttgtttctaaggaaattatccatgagccaggagcaggggttcatgggattcatactgaaatacatttgaagctgaagtaggatgattgcaggtttgaagcaaatccaggctaaatagcaaaaccctgtctcaaaaaaaataaaaaacaaaacaaagaaacaaacaaagcaacatatcaatgctgacttggagacagtgcctacacaactcattaaagacagagaagctgagctagaaccctagaaccctcaccctatggactaatattcatggtactggaagggactctggtggatgatacctaatgagaaagataaacatcaatccagttacaaatccttccatctaatatgatgtcttgccggaaagatatgaaggtacaatagcgatgcaatgcttgtgggaataacgaataaagatctgatttgatttaaggttcactccatgaaagggaatccatatccaacactgcttgagtggctaagaacctgagactagataggccatggaacttggggaaaccaaatactactgttatgataaaagaatgtagcaataaaatgactcctaacaacatttttctatactcatagatagatcagtgtcttgcttttccatcatcagagaagcttccttcagcacaagatgagaacaaatatagagacttacagctaaaaaatgtgcagagagtgagagagcttggaacactcagccttaaatgggatgtctccatcaaatccctccactcagggatcatggaaccatgaaaaggcacaaagagtgtaagagccagaagggatggaggagaccaaggaaacaaggcctcctaaacatagcaggatgatgcacagaagaactcacagaaactggggcagcatacacacgacctgtgcagcagatgaagtcctggagctgagaggagatgtgggcacatttcccacccccatctctaaacagaaactatttctaatcgataaccacttgaaaatgaaaaattagttttcttcaattgaatttccctggtaaaacaagccactcttaagggaaggccccatgccctgcagtggatggtcaaagctaaatgaacgtgactcagtggcatctttgatggttcctagtctcataatatcttgtcggggcttttttcttcctttctctccctgtttttaagaaaatttaaattttatttttatttttagctgtggttttcctgagtgcgcaaaataattgggtctttatatctatatgtttttttttgttttttgttttttgttttttttgcatgccttttcttggactctcttccttatttgtattgctctattctaattagtttgtttttgctttgtcttatattttattattgtcccttagatgactgtttgttttctaatgatatacagaaaaggagtggatgtggattggagagcaagtggggaggagctgagcagagtagagggaaaggaaaccaaaatcagaatatattgtatgaaaaaaatctattttcaatacaagaaaaacaaaataaaatctaataaagccacaaatcacatgctgaattggagatggaggtgagttgtagagagagcacttgcctgtcatgtacaaaaccctaggttagatcccggcacaagaagaaaagggacagaagaaaactcacatgtaaatctttacaaagagggccataagacgccttatgggttaaaagggtaaaaaacatttcctaggcaaccctgaagacttgagttccaaccctgaatcacacacacacacacacacacacacacacacacacacactcacaataaataaaatttgaagttttatagtgttggtcttctgagtgaatttgatgctattgtagaagcacatgttaacttttaatatcttgaattagtagacttaaataaacaagagctaagtattcttagttatttattaggtaaaatataacataagataatataaatcagtctccagtttgtcttgcttactccatgtgcataaagtcctgagaggtgtaccgtatataatgtgcttcatacagtctttgtggtcatttctataaaatagcaaagatcaggtcttagataataatttttctgtcatatcattatttaggaaaactgaatcgcaaatctgcatttgccaggaagggaagaagccttttatttttgtcaggatgccagctcttgagctgtaaagaggcatatttgccactatgtgaacagcaagggaatggcttaaacaactggcttctctcaacatgtaagaaatgcatagataacaatgagtaaataagaatgagtgtgaggccaggtgttggtggcgcacgcctttaatcccagcactcgggaggcagaggcaggctccagagtgagtgccaggataggctccaaagctacacagagaaaccctgtctccggaaaaaaaaaaaaaaggatgttaaaataatgatgtgacagagtatatgaaacacaaataacctgttttaggctggcctagctattgcctgccagatataaataatattcttattgtttacatgtgttgtttagtttttatgtacttagtaattattttggacaggtcagaaaataaaccaccaaacacaagagacaatagtttttaattgcacaattgtagtcctgcttttacagtaagtatgctcatcttcaagagactgtttaccaatttcttaagggagtctaaattgagctgatcatcttggcgtgcatatggaatgtcaccacactggaggctccgtcaagataacaacatcaagaccactgctccacagtgggtctcggtctcaaaagaaaacaagctaaaagcaactgaaaacaagtcagcagttccaaacactaacaacaaaaccctacacttcccaaagtaaatatcctcatgaatactgtggtgtttctctcagccacatagattagcaaggaaacagaaagcttgccccactctgttcatccctacatctgtgctttaataacgtatagattggagggataccgttcatgatctgttaagagactcctggaaaacatcttggagctttggtgaatgtagagcagggaggtctgttctttgttaaaaagcattatatgtatatatcctgttcattcctgttaaaagttaaaggcttcgttttcaatatattgtttaaaaccacagggggcaagaatttgggaattcaccatccacttctcaccccctgcccccaagaaaaaattggcactgttgtcttctgggtaactttgtgtggatcagtcgtttccattatttgctttcattcccaaatctattaacatttatctccatgtaaatggccttagtagtgattagtgtttgtagttttgtcttgttgataagcttttcctccattgggaaccatcacccctctagtcagagaggatttcaggagtttggtggcttagctagtggtcctacagctgtaggttcaattcttatctcagctatccggaaatgtgacagggttttggagataagttttattttcctgtctgccttcatttcatagactttgtctgctttactagttcctttagaatcagtgattttttttcctacgtggtgcattgccagacccctcaacagactggtaatttgtttcctaatcccaatccctgtgactggactcctgttacatactacctgatcacatttctgtctgtctgttgccaaagttttgagactttaattttctggcctcatgctgagacatccactggtatacttccagagtctggctgcctgcctggctgcttgttacctgcagttacattctgtaatggtgtagcagtttatccaaactcttcctggtgatgccaggaccttctaagtcctcctgtcctgccataattactttctttagcttctgtaccttggtcagactctgcctgccaacatctggcacttgttgagatgatatctcccaacttaggtgtagtctttatttccttggggtagcattttgctaattgttatttatctgatattcctttcctttatttcctgtatagaatgtgtggtgaagtagggtttgttcctcctaaaagagtcttgggggcatttctgtatttcctctggggctgctcgagttccaggccttaggacttacttcatctagctttaggcagagaggagcagtgctgctacacctcatttcctcagggtgtggcagagaagctaagtggagtactagccaaaggagccagctggactttgctctgctgtgtattcgggatctgtgaagagttttatttatttatctatttatttccaaaagaaatccctactaaaggaaacatggttctgaaaaatcaggtttcaaagttgtctcaagtacctttgccaaaactcctcctaaaacactttatgttttataacttccttgctaaagatccttatcagcgaataccactgtgtcctacactccaatttgtttgcatactgggaaaaggttatgggctgactgcatttcccagtattattccgcacccatgttcttatgattccagcataggttcatcagcctttgaacatcgtccatcaagatttccaggctgatccacatgacgtattttccttgcttcctttctttgttttgccttttccaatctgatttctgattccaagttcagcagcgcaagcagctctcttagaaaacttcatctctttgaggcctaatttgtctcatcctttctctctagtacgttgttgtcttttgagtcagttcttccagttaggaagataattgtcctgccttcatgtctgtcttagtgtttctaatgctgtgatgaaacatcatgaccataaacaacttggagaggacaggctttatttcatcttatgattccaggtggatagagaagagatcatgcaatcagtgtaggaacctggaggcaggagttgatgaagagaccatagaagagagctgcttacttgctaggtccccacaggttgcttggcctgctttcttttatgttttagaattaaataatgactttttccagcttgttttgtgtgtgcactgcctccctcctctcctcccaccccctccctccaacctccccgctgccctcccccccccactccccctcatttgcttcacccagcaactgatggaaacagatgcagagacccacagccaaacattaggtcaagctctgggaatcctgcagaagaaagggaggaaggattgtaggacccagaggggccaaggacctcagaagaaaaaccagagaatcaactaacctggactcaagaattttaaagagatggaactgacaaccagggaacctgcctgagactgacctaggatctctgcatacatgttacagttgtgtagcttggtcttcttgtgggactctgaacagtgggggcagggcaggggctgtctcagactctgttacttgcttttgggccccttcctcatccttcctgctttcttatagaacccggtggtggcagctgggcccttccataacaaacactaattaagaaaatgcaccacaggtcaatctagtgggaacattttctcaattgaggtttccactttcaaaatgattctctagcttgtgtcaagattatatataactacccagcaaaaatgcttgttttctcctgtatccccttttctcattcttcgttcatttatttatttattcattcattcattcttttttgaacattagctcaaaccctagactagtcttaaacttgctgtttttgcagtaactgactttgtactcttttttctttcagtttctttttaaaatttttttgatttcattttacattccaaccacagctcttccacccacccctcctcctagccctctagcctactcccatccccctcacttccccccagcccactcccagtccactccttctcacagttaattattcccatgaggagtcaacatagtccagcacaatagcttggggcagggcccagcccctctcccatgctttaaggctgagcatggcatcccaccatggggagtgggctccaacaagctagctcatgtaccaggtttgtattgtggttgactgccagggggccctctggtagtccaagcttcacaagtgtctcctacatacagagggcctagtttggttccctggagtctccacagttgtgggtctagagttcaggagtttgcattagcttggttcagctgtgtctgtagatttctccatcatgatcttaacctcccttgtgcatatgttccctcctccctctcttcgactggaaacgcagagttcggcctagttcttggttgtggatctctgcgtctggttccatcaattactggatgagggctctaggatgatagttggggtattcatcaatttgattacagggataggccaatacaggcatcctctctactactgctatgagtcttagctgggatcctgcttgtggattcttgggagttaacctagcaccaggtttcttcctaagcccataatggatcttcctattaagatatccctttcgaaatgtccagagatctacaaggatgacatcaactaaccatctaagcaacagtggagaggctacattaaatgccctcccctgataatgagattgacaactaacttatatgccatcctatagccttcatccagcagctggtggaagtagaagcagacacccacaactaattactgaactgaactggaatccagttgcagagaaggagaagtgatgagcaaagggctcaagaccaggctggtgaaaaccacagaaacagctgacctgaacaagagggcctccagactgatcactgggaaaacagcatgggactgatccagaccccataaatgtgggtgtcagtgaggagacctcgtaaatatatggggcctcttgtagtagatcagtacttatccctagagtaggaatgaactttgggatagagggatactccctcagcctagacacactggggagggcctaggccctatcccgaaggatatgtcagactctgaagacccccctcccctggggagcagaaatggtattgggtaggtagggtgttagtgggggcaggggaggaggggagggagagggaacagggattgacatgtaaaacaatcttgtttctaatttaaataaaaaattaaaaaaaatgttttccccaaattggaaaaaaaagatatccctttcattgctcttatactgtatccctctctacctaggccatctcgttctctcctgttctcatccctcctcccccttatcccccagcccccaacttgccctgtagatctcctctaatttcccttcccagggtgatccatatgcccctcttagggtcctccttgttacctagcttctctggagctgtggattgtagcctggttaatctttgctttacatctaatatctatttatgagtgaatacgtaccatatttgtctttctgagtctggattacctcactgttggagaggatgtggagtcatgaggacattcctcccctgctggtgggagtgcaaacttatacagccattttggaaatcattattgtagtttctaagaaaattgggaatcaatctacctcaagacccagtgataccattcttggtcatgtcccaaagaaagtttatagcagcattgttcctaaaagccagaacctgcaaacaacctagatgcctctcaactgaagaatgaataaagaaaatgtggtacatctacataacggagaactactcagaggtaacaaatgatgacttcatggaattttcaggcaaatggaccaaactagaataaaccatcctgaatgaggtgactttgcactcttaatcttttgcctctacctctgaagtgttttgattaccacactgcatttgaccctttgttttcttgtttgttttctcaggtagattttagattgagtgatgaaggagatttttatatttagaaggttgctccattacaaatgtctgtgtacctcaaacaacactctagcaattatttaactggagaatatgtcaaaataatctgaaagcccaattgtttcattgatgaattttcttagcactttaatcttccaagtaagcagaagccaacttccacatattcaagcagacttagtcatacaaaaacattaaagtgaagtatttagtataaaatgctgtcttaagcatgactatccactggtttaatggcttcaacctttaagttttcaaccatatgtaatgtcgtggcaaagctatgagcactcactgaagctgggaagaccttttaccatgtgatttaaaaagttgactacttttcaatttaaaattctcataattggatctactaaaattcaatgccactggggacaaacaacagggaggagacattaccttgatgacttttgctgcattcaaatgccagtgacaatttaatctccagagtatttttattaggatagctatctttttggttaatgctctgacttcaaagttgtttcaaatttaagtgatcttgtttgaccattttctggaagccctgttatctatagtatatagtttttttttttttaaaaaagaaaacagaacaaaacaaaacaacaaaggatatctagagcttctctaggaagatatatatgacattatagcaggaggtatgacacctcttctctcccttgtttaactctgtgttgcatctagtttgatgttagccacataatttatgcttagcaaacacttgtttgcttttggtcatctgttgactcataaatatattttgctgtgaccttggagttattttctcgttctttttttctagtttgtgtttcctcgaatttttctatgaatggcagattgtttagatgaagataatggaggactttaaggtcaatcggaagaaagatacacatgagaaactagagggagagactggtctaaagtatacttttgatactctagttgatggggagagccacccttctttttttggcaccagaaaaaagactacgtcttttcctccacaagtctgtttgtgcgtcacaagaaggaaaaaaattaaaggaatgtaggtgaaatgagatcagccataagacagctgtttgctgaagccctaggttcacagttaagggacaaagtatccttgcctgaggctactgttttcttttttgtgtgttagtttccaagagagaccaatgaccctgattcctgcaaaaagaaaaaaaatggttgctgtgtgtgtctttgctttatactttgtttttcacattaaatagggaaaaatgctgaaaaacaaatgatgagacttaagacagggtctgaaataaccacaataaagccaaatgcaagtcccattaggaacatacttttccactttttgtagagattatagatcttttataggtggccaattggttagcaaatggagtttcgtcctgcctgaggacagcaaaaaccaacgttgcattcaaaacgtatcaattcagtttcaagtccataaatacatgtcatagagaaataattcatattacaaggcctttccctccctagctttttaaaaccacagtgatgtgtacaagtaggagccttcataattgttcagataacaatgttcaatcctgtttcttattttatttgtttggttttctgtgacaaggttttactaggtaactttggctgtcctggaacttgttatttagagtaggctgtcctcacagtcatggagatctgcctgcctctgcttgctcaatgtactattatgtcctgctgtgtctcctcttgcaacagtcctccaccttaggtgtttttcgtttgcttgttgaaattacagggtctttgcacatgttatcatcggttcctttgcctttgtggaatgctctctgtgcttgtttgtacagcaatgggtcaatacatttttgttaaatacttttctcagtaggctgagaagtccatgacgataaactacatttgtagtactagcttgctggtatttaatgtctttaagtagacttttaatagttaattcaaaccttatcttcttcaggaaggtgctcttccgcctctgacatatatactacataggttccccatcacctatttttgctccatgatgcaattcatttagcttgtttcttcagtagcctaaagggcagaaattaggtcagttttagccttccaacacaagtcactttttataccatctggcataaaaatgtttgccgaacagattattaagcaatgcttaaacttggtggcatctccctttgatccatacccacatttcttctagagggagtatgtgaaaatgttagccatatcattcattatgtttctgtagcacctattattattttttttactcagtatttcaggtagggtgacatttagataaattcaattatgtatgtgtgcaatgagtcaaagtcaaaatatacatcaaattccaagttgcgcatgagctttaagaaagcaaatgtatcttggagcttttgtccattgtatctgagagcacacactcctttgctgccgtccttggggaaatggctacttctggaacatagacatcttaccctcatgattaaaaagaaacagtgggcaaagaagatggtgggatttgagctcttttgagatatctaaaatcttttcactctgttgttcaagttacttgcgtcaccaaattcatcctaatgaatgctcactatattcatttggctccaaattcatttcagcataactaacttcaaattgaattatagaagaccaaaagaccccattgcccaaagttatcttggtcattaacagggttatggacatatttacggacttggtgtttaagctttattacaaatggcttccccagtactttgccctacatctgtgatggtttggtggttccttcagatgctgcttttggaagggctcttttggaaaagagtggggaaagctagttgctgaggatgaaatagtagggacctcgtttgggctgaggactatgtatgctgcttgctggtgctatataaaaacactagaagttgtctagggacttatcttttaaacaacactttgacatacacgatcttatttactcttcacaataaccctaaacctaaactagcttgggaaatcgaagatagaactcagctcaatagtaaagtgtaaagaggtgctttggttaaagagcctaatatcaccctaaggattacttggtgaggcactagtggctttaaccactaacagactgggaagaaagcaatgactatttctttggccacagtgcaatcatggcaacagaagcacccactctttccactttgacccatacaatctgtctaaggcaattaatcagaactcccagtggttttcctacacgttgccagttgccttactaattaaaccttcccacagagtgtagcaagagcacaccccctgagggccctctgactaaggaaggtatattgaccaacactagtgaaagttgagactcagttggcctcatcagtaaaatgcaccggagaattgtcctcactcagtttccctgtctctaaaatgggctctcctttatccgtctagactagttcccttccttttggtgctagtctatcaggaagtgaaatcagtgcttaaccaccacagaatgtcctctgtgaggctccagtcgccgctccgggcatgctcagtagcctggcccgctcagcaccaagagtaggaagaggcttttgcccgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaccttcttttcgggattccatttccctcccacctcttgtcagttgctgtttggcctcttaacacttggggtccagggcaggggaacctccctccgctccgtttcaaacacattggagccaactcgcagctaagtaaatcaagacaagcacgacataggttcccaggtccttcgactttgccagaaatccaaggaagaggcgcctgcgtgccttcccccccccctccacaccaccatgtgctcactcaagaaacatttcttcggaagcgcgtggttcgaggagagcgtgggagtggagcctacgggaggcccgctcccccaatatcccgctacagtgtttccacttgattgagaatgctcaaaagcagccctatacccttgatgtgactgacagccccgacagtgtagacaagtagtagttcatttcctgctgaaaggcaagacatctatggggcctggtgttcggttgggaaatactggggtttcttcagctcatcagttaaaagggttcctctttttgtaaactttctaatttcagtggcatgtggagaaaggggttacgagcacagattcagcacataaactttgcagcctctcatgagccctttaaagcagaagattcctagttcacatcccaagcacaagccacatgttgcatgtctatatttcatctgtaaagcaacaacttgattataatagaagagagagtgagactgtgtcatgcaactcaaaccatttcctgtggcatctagccatttggtctggacttacacttctcttttggctcctatttgctttcctattacagactgcccatatggggaaacaggggtcaaacatcaggacatacgaaggcttccattatgtgggaaaggacttccgctaggttaatcttacaaatttaaaatctcatcaattccatacaaacctgagaaagttatggaaattacttcttaatgtgccctgttattccagcctttctttacaaataaagaaactgagtcactttttttaacttgtctgtactatctatcacagttttaatgagtatctgcaccataatgaattcgaggaaacagttctgagtgtattgctagagtttaatgtatttagaattttttgtttgttttgttttttaggttctttctatatagtcctggctattctggaacttattatgtaggctaggctgaccttaaactcacagaaatcctcctactttggcctcttgagcatgtgaaccaccatttgcaaccaagtagtcgaagttttaatgaactgactttgaaattagtcagtttgtggtaagagagtgatctttcttcccccgcccccctacctgccccagtctagactactctgatcagtagtaaaaagtttaattgaaaagagaagttaaggaatagtttccatagtagttttatacatctagtaagaatcttccactttcaaggatactaaaggaaaaatgtttatctcaattaataagaacactgtggtaatattcttccttctctttggctgtttgtcctatttcatcttttatattttacttgatttgacaaggtaactagatagccatgagatagcatcactttcggttcccagctaacttcactgttccatagtgaacatagcttgatgcagtagctcaaatactggaaccctgagcataatactgacatgaattttcttccttcccccaagtatatttttgagctttgcatgatttctataagttaacatgtcatacacttataaaagcaggaatgcagtaaggcacatttttataaaaaagattttattatgtatacagtgttctacctgtatgtttgcctgcaggccagaagtgggcaccggatctcattatagatggttgtgaggcaccatgtggttgctgggaattgaactcaggtcctctgggagagcagccagtgctcttaacttctgagccatctcttcagccatgtaaggcacattttaagaccaaagagtttgaccaaacaatatgatttggtaaacttttcgaatgagttcacctgagatttttaacttaaagttttgcaaatagaaaactttagattttaaaatgtcaatgctctatattatgtatcactataataattcccaattatgagtgtgtgtataggagtcctgtatgataacaaaacagtcgtatggcaatagaaattgtttgtctgggttattgtgctgttaagggttcaaagctcttcaaaatatatgaaaaaatttgagtatgttcattttttttttggtttcttgccttctgttaagtttcttacaagcatccatgacttgcaggaaaaaaaagaactgtttcatttcaaaaggcagcaaaaaaggtgacagtagggtgattgaggactctgataaagggagaagagaaagcattggggacaaggaagagccatgcaagaaaaccctgatgcaataaaaagtttagatagcaatatctatatactgttcagccacaatggaagtttctgtcacattacaaaatttactggatcactgtagtctaatttttttaactatatgtcttgtgatacaattgcatctcttttagttgctcatggatttggaaaaaacaagaatatagggtgtatttcttttcagacaaagtgacatttatatcctcagcttattgatgtcagtgagaactttttcacattctccattcagaactgtaatgatttctgtttaaggttgtgtgagtcaaattttaacagatttcacctcagttatttttttcagataggtatcttcataatgagcgccccccccactttccatacatccatacatccatctgtctatcagggaaggtagttctttcaacaacacaagacattttaaatgatatattgctattagagttttggattttatgtaactttctggttaggcccagactgtaacatgctattaaccagcatgaatattagattaattagtaatttgatgtcaactgtggcttgtattttgttaaactgaataggagagaaagtgccctagagaagtgtaagggagaagctctatcttgtatctcacatatttaaagcaatgatttaaccattcagagaatgcaatgttgtggttagacagttcagttggtaaagtacttgcatgcaaatgtgaggactgagtttgatggccagtgatctggtataaagcctggtctggcggcactcattggttatcccagtgctgggggtaggagaagataggccgatcctaggagctcacaggccagccagcttagcctaaccaaagggggcccataatcctttgaaagagactctcaaaaaggaagtaccttctgataaatgaccccaagattgacttctggcttctacaaatatatgcctgtaccggcaaacacaagcaaacacagacacacacacacacacacacagacacacacacacacacacacacacacacacacacacacacacacgaacgaacgaacgacaagggagcgagagtgaggaggacatttttaaactgtatctaagacctccatcttccatcacaagatggtggatatagagtagtctgacactagttgaaacttttatatttttattttcttcttgtataatttctgaagttgttgcttttttcccccaactttttcatttgaattagaaacaggagtgttttagatgactttcccagttcccttctcccacccgtcctcccctatccccccaactaaaaccttatctgtcacatatcttttcagctccccctggatggtgaggccttccatagagtttcatcagagtctttcatatcctttggaatagggcctaggctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgctcttcactggtccttctctgcatctgggtcccagttcagattggtgattagttatgggtgtctgcttctacttccaccagctgctggatgaaggcatataagtcagtcatcaatctcataatcaggggagggcatttaaggtagcttctcctctgttgctgagatagttagctggtgtcatctttgttgatgtccagacatttccctagtgcctgatttatggagatatcataatagttgttgctttctttagacagtgaaattaagttaataacttttgctgataggtgtgagaggtagaagaagccagaattagagtgtttaactgttaactaaaagtttactatactagcacactaatattctggttactgtataactgagaactgagtattggctatttttttgtaattgaactacgttttgattttcaatacgatgctttgagcttaatggttttatgtacagactttgattaccaagtattcaccataacttccatgtttggtgacaagaagtgctcacagtcaggctagggataatggtgcatatctgtatatccagcattcttgaagtaggaacatcttacatttgaggccagcctgggctatagggtgagacctcctcttcaaataatactcctagtcaagcgaagcagagaagggaggaagggagttaattatatgggggtgctataaaaatgttacagaggggcatttcagtcaaattggatttggatttttttaaggtttttctagacagagtttctctgtgtgtatccctggctgtcctggaacttgtactgtaaaccaggctggactataactcagagatttgcttgcctctgcctcccaagtgctgggattaaaggtgtatgccaccactgcccccaccaaattggatttttaaaactatctctttatgtattaaggtgcagcacctgctttcctgagtgctgcctctggggtattgatgtagagctcaccctgggtggtgaggatgggggtgaggtggggggctgaccaaccatgcaactacccaggcccagaaccagggctatgagttggcccaccccaacatccaccctatctatgatctgttggaggatgtgaaggggctggacctatggatccaaacctacaggatctaagatcttcctgatacagggcaacaacaggatatccaagaggagtcccagtgagggcccagtatagataatgcagcagaagccaaaccagaggcctggaaccagaccagtgactcattgcaatgaacacttgcaagtaaagatatatgggtttactgaatgactcactgggccacactgcagcttccacaatgagtttttttttcttaaattttattatatttttgggtggagctcgcaaggacagagggcagaaatgaagggagggggagatgaatgggatcaagattcatgatgtgaaagccacagagaataactgaaaagttaaaaaagagaccggcttatagtagtacacatgtgcaccaaggcttgaacacagctttgatttaagaaggggagaaaggcattctagataaaaaaaaatggcagcatatacaaaggtagagagatgacgaaatatgctgataaagaatgttcaactagagaggactggctggattaaccaaaaaaaaaaaaaaaaaagacccagcagaaacaaaaagaagttatatttatttgtggatctggccacaacgggatgggctctaggtcacagtagatttttgtgtctcatgttggagtttcgactttttttctaaaggtccgactaagttgttggggagattaaaatgctaaggttccctggttaggtatgtctttcagaaagaaatttagacctgtggaaaaattcctggaaagggatgctggagtggaggcagaaggtccgtgaggaggagcagagtcgtgtggtggagtttgccatttagagtcctggattctagttgctgctcatgtatgccctgcatcggaatctctttattcctgtaatccccatttcatctcgctcccgacaccaccctggatagtctcaccaaattggaagcatttttctcatttgtctgtaatgaattgcagtgcttttatagcctagccgctacctctgtgctctctttcttcctttaagccttcactggttgtttcatcttggtgaggaaggggttctgccttctgaacatttggctgccataagtttcagtgttatatactgattttgctttacagagattttcaagtgcttcacgacatggctcctcttttttgtttattcttataaatcagccatcaattattaactagggatttttttctctataatcagatatattgggagttacatcgttgaaaagagacaataacaacaataaaccaaacaaaaacaaaaaagaaaagtggtggttctttgtttttctttttgagatgaggtttcatttattccaggctggccttgaacccttatatagcttaggatgatcttgaacttcttattcttctgcctttacttcagctgctgagattacatgcttgcatgctgtatctggtttatgtggtgccaaggctgaggactcaacccaggacttcctatgtgctaggcaagcactctataaattgatcaatatcccaagcccctaactgttatcttttatgtgctatttttttgtttgtatgtacatgtgtatgttatcaaatgaactttcccgtccattcttctgtttcttcttagtcctttttttagagccttgtctgatcttgaattcactaagtagctcctgagctggccaatactggatcctgtcttcctccatatcccaaatgcatggattatggtctgagcctccattcctggttcctctgtcttttctctgagttagaatttcaaacaacttcttcagggtcatgagaaactccctcctccccttgtttgtttagattcttctgatgtcagagctggagctcccatgcagagagatagtactgatattacaaagtaccaagtaacagtttgctgttgttactaggaggcttcacaacaagctaaaaatgatacagattgtagagtcaaaaattctgggttccattgtcttttctgtcttttatttgcttgtgttctctggtgagcattaataccagaaatttcagcactttgattaatgtctgccctacagagatatggtttcttgcctaaaatgcttgtttgatttttgagacagggtcttgcaattctgttgcccgggctatcttttaactcccgacctctcaggtgattctcttgtcacaatccccttagtagctggaactacaaaagcatgccatcttgtgtgtctgatttgccagacaacatggcttagataaaatacagtaaacattaagaacacatttaggaaattctataaagttatagcaatatatattactgttagccccttatatcacccgaatcaaatgtggttatggaactggggcatagcgccacggtagagtgcttgccttgctttcatgaggacctgggctcaatccttgctctcctctccagttccctttgtttttgcagcattgcacatcctgtccatttactaatcatcctttcttctgagtgactgtagatgtgactggaacttttattcactcattttttaaattttaggttcatttattttatattatgtgtatgagtgttttagcttgcatatatgtgtgtgcaccacatatgtgcctggtgtgtgtacaggtcagaaggtcgtatcaagtcccctggaactggaatttcttagtgttttgaaaccaccatgtgggtgctgggaaacaaactgaggtccttgcaagggcaataagcgcttccaaccactgagtgatctctctatcccacactctgaatttttaaagaaaatgtctactgttttctttgaactgatcaatttcaggcatttgaatattttttaaattcagtaggaatgtatgacatactgtcttgtcagggagcttagtgatcttgtgcaaataaggaaactgagtcattcaggtgctatggggactgacttagagataagtttaaaagctatcacctctattgtagaagttatctatagcactgagtcattatgcttcagggactcttaaaagtaaaaagttattcagtctctcacttcttttgttcctttttgaacaatttataattataatcctccttagatttcactgtaagtactaagaactttgccagtagcagtatgtcatgtaagtgaaatcttactcatttctaacctgttcttaaaaaacactgtaaataccagtatgctctgaaaaagtatatagtaatgtatgctaatttatatgaatcagcacatctggttaatatattacctggtagccttagcattgaaatggttattattgaagatccagatttctctcattccttctgccagatttgagaagtatgtcatattatttttttcctgaagacagaaaaggttacatgacataataacatagttgtaatctttcagcctaacttggcctcatatgagggaaacccattgtggaagacagctcacaattggtgcatgtatatgttgatatgtattttcacatggttatttattgtgaacctcaggataggaagaaatatattctctccaagttaaaacttattaccccatcaggctgaatctgatttaccttcaaatgatatactttgaccatagttttaaacagaaccttaactgaatctcaatacttgctttgaaaggggtggcctagggaagaagacattggtgccattttgggggaaataatgcagaaaacacaatttttaactcattaccatttgcactgtctttgatttagtgaagatttttactgaattgctctgggaagagggtgctccattgctaccaaaaccttgagtaaattggcttcccatttctatcatttggtctctataaagtggtgcttctcataagtgagaagcttctaattgattcatacaagctaggtgcaagtcaaacacagcattaggaagaaattactcacaatagccattgactcaattactagtaattgtgatgcttgcctaaaggatgggaggatttgattacagtcctttatttttgagacagaatatcatatagcccaagctggcctcaaactttctgtgtagttgagggtacctctggacttctcaacctcctgcctctgcctcctgattgctggaactaccaacatgtgccaataatacacaatttacgagacaataggaattaagcctatgaattaattcatgaaagggaggcaaacactattatcacctgagctactgcctcagcccacaatcattttttaaagttattggttgtgctgtgatagttgtttaaagatagccatatgttttgataaattcaacattttgaggaattttaattgtacacctaatttgttggtcttaagagaaaagtaaaactaagttgaaatattttaaaacatagcaaaactactaaaaagaggatgtaatatggtgacctaccatttatttattactcagacagagcagttggttctctagaatttctaaatttactctatcggtcctttgttttttctttgctagaggattttaattcacactccagatatcttttcatttaactcctacagacttcagtctgcatctctaaaattgctgagttcttaaaaacaatcactatgccactgtcccatctttaaaatagtaatacaatgcttggtgttgtctagtgttgaaacccataatcaagtatcctcaattacctcaaaattaatttgattcttaatctaatgtattcataattaatgtatatagcaccaaactccttagataaatatacctttaaataatgttaaaaacttcttcaaagttactctacataaataggttcacctttgtctataattctgtaaaattaactatgagagttatctgtacaagtgtaagtagactggaatagctactctgtaccatagaaaatagattaaatttagacttctgacttcactttttttcattttgtgattgtgaagtggagtttatgtggaagaatttttttgccagaagtgctatagatagctgggcaaatgggaaaatattcttgaattctatacatataaaagatgcataaaattatttgacaacatgcacacacaataacatgtttagattactacttccattttttttttgtttttttagacagggttcctctgtgtagccctggctgtcatggaactcactcagctgcccttaaactcacagagatctgcctgcttctgcctcccgagtgctgggaataaaggtgtgtgcaccaacaccccccagtttgctaactgtacttttattaccaaataattgccaatttgtcaccttagataactttctttgttaattagtcacattgacatactctaagtgtgcatctagttgaccaggccagtgaatctttgccagaaactcagaattatcattgttttaaaccaggttatattaatgaggtgattgtgctgtggatgggtggagtggatcaacttgggaaaatggattctccaaagactgttttaagaaattgtataaccagtactctgtagataccagcttggtgctattacagagctgagaggcaattgggtgtataatttctctaacttcatgaacttttaaataacttcattcttgtaatctatgtctccttcttgactgagcagttactgactgagtcaagtgggtgattgtcctctaaacacataaatgagtgataattgttggggctccttagatagctggctttgtctccgtttgttttgcttaagggaaggaaagttctggatgtgttgttttatgtgctttgaaattaatcactggtaaaatctgaaatgtttaatagcatattaagcttgcccgagctatttaggaaggttctatctgtagatagcaaggcactgtgcttttatatcttggcctttaataacatgtatggtataatagtgatgtgtaattatgtagggttgggccctacacaatggtatcagaccatggagatcacactatttgccaacatatgccagacataaggctctgtcttcctggagtatttttctgtttcatacagacatctcatgtgggttgggtgatgatttaaaaccaaattgatttcatttttatacttgcaaggaaattcagcaagcacagggaatggttgaatatctcatatagagtaggtgtttttttaaattattctttatatgtaattatgcatatttgtttgtttgtatgtgcatgagtatattggatccctggagatggatttataggtacttgtgagctgccaggtgtggtgctaagagccaaacttgggtcctctggaagactagtaagctgtcttaacggctgagccacctctccagtcttctagaataggtatatttcagttgtcattcatttgtaataagcatattatgtgtatatctatgtaatataatgtacccgactgcttttggttttgaattctgaaatcctcatagatggatgactgtgtccttggggttcagcaaggctctgctctttctctactcctcgcagtgattttcttgacattattttttttcagagagctttagatagtcatggattgtatggataagactgtacttttttgaagtttgtaatgtaacttgcatgtatattcatttacatcacctatgatacaaggcgagaacatacagaatgttaagatgggattggcagagacagagcttcttataatatgctatgcagtctggtacctttcattatgaaatcaatgtttttcagaagagtccctgtgtatataaaacatttagcatgaaaataacctttcttaggttgcactcacagattgtttgtcattggcactgcagtagtttacatttctccccctttggttgaataactaatggtctttaaatggaagaataagtttagtaggccaagaaaaaaaaaagtctggattttatccatgttgggcagctcagattatttgtgtatttgtgttactaaaacagagtgtacctatgttctgtgatctctaaattcttgactcttcagtacagcctaaagttgctctatcaaactgttttcagatgctcttgtgagatctaaaccattcatttttatataagctgagttggcctgagactacatcctaaattctaagtagctgtgtctctatatcaaatgaaatgagggtttagttgtaactgaaagtagtgattgcacagggctgtaagccaggtttccacacttgtccttccagttctgctatagctaattatggatcgagttatattattgtattacattgcagatcctggcttttaactccctccgtcctttaaaataatgttattacttgaatgttactaatcccgaagatcatattccttgtcatgtttattagttttttgaagactatcaatgtagaagaattgtcattgaatgttaaatcacttgttgaatgtctcagatatttctgtaatagcatttctcattcatgcccattaccagccatgttgccatgaactagtggaaactccatttttgtcttaacatacagtacaagttttcaagacctcgaactatattttatagtagttaaaagtacttcctatgctagtaagagttgaactgagctaagtaggatatgtgtgtcatcttattgtttaaaaagcttgtttctgactatttgaggagatttctaagacatgaattaactttaaaatgtatttatggtcatatcattttttctatagtttttgctgtcagtttttttctctgtacaacaaaggggtagaaataaatgatctgaatgggcttcgttcagattctacatattaaggatcaaagattattaagaactttaatgaatctgccttaacacaaatgcattatatctagattttagttacattgaaagtgggaattatgaaagatcactgtttaggctgaatattaaaaactgaatatctcatctttatagttttgtttctagaatctgacttattctatctagtgaaggctatagcaacactcttttatcagtatacttccctttagagagtgttagcttagttctaggtcattctaggcattgagacatttctgtagttcattaaccaaataaatgctcaggctattgagagataattcagtgatagtcaacatcatgcctcttgttatgtttctgggtttgttgcatctatttgtgaagagccatacaaagaaggcttggggaatggtttatcagtttggaccagtgcccttgcagaggacccaagaggacccaagtttcatgcctagcatccatatctggtggcctgtaactccagaaatccagtgcctgtttgagcacttggactcatgtgcacgtgccacccccatgcttatagttaaaaataaatctttaagaattatacaaagtgtgagattttatactgtgtacccagtgttccaatttcacagatcattgacgaatacctaagacttcttgatcagagacaaagaatactatcactgaaaaagtaatagcaacatgtcaacacaatactcgggttcaccttaatcttaagtcccatagggtagatttggatgatgggtacaggaagtgagttgtactatagcagaggaacacttgagggatttgtcactttaatagtgacaagcacacagcctgctctttgctgggattgggagatgttacctcattctgaaaaccacttcttacaaacaaagccctgggaaatagcctgtataaaatcccagcagcacctttcagtcttgacacacagacctgtaatgtacaaggatggtctaggattgatggcggattgtctccctctgaatattaacacatttcaccctgacagacatcggtttgtagggaacaagaaaggctcagagcagctcagtaacttgcctgagactctgcaacagtgaacttggcatttaggcccaatgtgattataaaaatctatgttttaacccatcatttttctatactgcctaagagcctaaacctccgggttgctctaaattaaccagaagaccttgcagtaccgtggactggtgatgtttgggacctggcccacatttgcaccatgtttatgtataatttagaagacagagttcaggggccatttgtttcaatgttactgaaaatcccaagttaaaattctttgaattgctgccatgaaatagtggggaagatatgtgaccatttgcaaaagtgccatgggcacagaagggatatgactgtggattttaaggctacacgagcacagttcttaaaaatagcagtcttggtagtttgacctttattacataatttctgagtcacctcaaggcttgctgtgctttagcactgccattgatggtgatacattctctttctttctccccatttatacttgagtgctttctaacagaatacatggcaaggcccattgcattcttcactcttctttcccctccccattctctgtttgtttgtgaacttttctgtgaggcaaaactgccttggaaaactaatgctggctcctattacacaagtacacgatatgcattgtttcttgattagggaagtgccaagaaccacctaccttctcctgctgcttcctgtgtctgctttgcctaaagattggctgctataaaagtgtggtacaggcagccaaatgcaatctttttttaattagtttccagaaagtgttgtgacaaactattttagcgttggtgtgtgcctagtaagaggccttagtcgtgggcttaaaagccaaataattgcgagtgcctaatgtagtttgggctctacttctttcagctttaagcatcatccctccaaaaagaaaaagagtgcctttaatttaaaaaaaactataataggtaaattcgatcatgaatagttcactgtatgcctggagcctgcagtcaagctatttcacacttatgatcactattagaaattaatgagacataatgtttatgcatttttatgggataccctatggtaatttgacacttactaatgttagtgagctaaaatttccatgttggttcttttcattgaactttttaccatgcttgagagagaaggatagacatgatgagagggctagtaattaagcagatgaagaattttattgtttttagttttcaagtttttccatccctcaaaatccatgtacacagttacttttccattgctgtgataaaataccactgtcaaggcaccttctagaatacagtttatttgggcttatggtcgtaggaagataagagtccatcatggcatgaagacatggcatcaagcagcatgcatgtagtctgtttgaagcaggaagctgggagctcacaccttccaatgtaagcaggaagtagagagagcaagctagaagaggcctgaggttttaactttctaagaccatcctcagtgacatacttgtcccatcaaagtcatactgtgccaagctacgaccataagcccaaatgatcggcctaatttagactctggctagctcttttaacttaaagtaaactgtttttcttgctctgcctttttgccttgtggcttttaacctggcttcttgccctggttgtgttcccctcattctctcccctcttctcttgttcatttttagcctggatttcttctcatatttattctctatgcctggcagccccacctagtcattctctgcctagttattgccattcagctctcccttagacaaattaggtgccttaagtgggcaaggtgaaacaaatgcagcatgaacaaaagtgacacatccttacacacttacagcattattctgcagcataaacaaatatagcacaccctcaccttgctaaaataatattccacagcaacatagtgctcaaactcccataaatagtgcaccaagtaagtgttcaaatgctggagaccaggtgtgtggcagggttggggcatggaatccaattcaaaccacctcaccatgttagttctggttgctcatattctccttttatttttgacttcaaatccagaaagctttaacctgtgttaaggacaagcacataagaaagggatttgaactcnnnnnnnnnnnnnnnnnnnnnnnnnnnnnnnnnnnnnnnaggtgtgcctgttttaattcccaggaagcatttaataatttctggagacatttttagagtttagagttgggagacagtgctgctagtatacagtgtgtagcagctgtgaagatcctttgtatcctacagtgcataggacatgtcctctacacaaagaggtactcagccccaaatgtcaaggttgagacagattgaagggctggaagaccttgctttagatctgactttttctttatttagtgtggaaaaactcctgttggtagctagatagtctccttttgccatttgtcctctgccctgtattgagctagggtcagggcatccatgttttcaaggaagtaccagtcatatcattggccctcacaacttgtattcttatcttcttccttcctgctaatccaagcctgctggactggactattaccagctttgtgttatgaattgtacttcttatcacttatcacatttctgacaactaaggaaaatgtgtattctcttcctacggggtttaaaaggtgattttcattttgcttattgcttgagcccttgccagctcttgatgctgcacatacttaatgcttcatctatatggcttttaattattgaattgggatgtggtcttgccatgttgctcaggcttcctttgagctcacaatcttcctgcttcagcccaagtgctgggattaattgtgggtgcgaccacacctggtgatctgtgtgtattttctactctgtgacattggcttctctggtaccttctgcttctccacttgttaaattccaaagtcctagtcctttctctcgtctcacagattttccctgttggtcatctctccacaccaattaaggaaacagaatgcctccccaaataacacctgcctggagctgatgccagacttcagttgccgtccacatctctgttggagactgtgccatggcaagccaagggctgtggtttggttcgactgcacacggattaaaagggaaaatactttatgacagtgttcattttaatattctactctgcaagaaacatcaaacccaactgtcccctcatgtggtatttgtcaagtttaccctctgaagttgaggtttacccttgccacacttatcagccgacagtatttctttgttagtagttaccgactgacctttatgattctgttccagtttaatcaaggttaacttccctatttgaccattgaaagtcactttcaactttgtgctcagctcaccagaactgaggctattttgtatttgaggataatattaggcacctaactctaattatcatccttttctgtttttccttcatttaattaagccatgtactgcatcatcccacgtatttgcaataacctctcctcttgcacatttattcttttcttgtggagtctaagtattttccatccatttcttcatgtaatcattaaactgattttacctgcttacagatgacatgatcactttctttgctttcaacctacaatttcattttgcagcccacacagtcttactaaccatggtgctcattataaatgcatgctacaatgtatagtcattccatggacatcatctccttgctatgtatgaggcctcaggctgagggcctaagtacagttacaaacaggtcttactcttgagaaacttgtggcctattgagaaaagagagaggtgactgtaaagtcgtaatgtaaataataaataggtatgatgagtagtgtgctgtttgcagtgccacatagtgtgcccaatagagactggagagcctcttcagatggtatgtttgatctgggtcccggagcacgaagaatagtgtggtcagattttctgggccttttccccaaacattcaatttgtagatatgcctggttatttttactactgacaacttgcttaggcaagctgctcagttggaagaattctacctttgaaattcttcttgttcaataattaatcaaatgtcataaatgttttataggagcccacctcagcattaagataagtaagcattattagggctaagataagcaatttctggctgctatgtacacagaattggagaatatggtgttctaaacacatggtacaggatggattgtggttcagtgcagatgcaggggtaaaggtgtttgggaacacagatgagtttcactttaaatggaaaatagcatggagggctttctgggaagatatggataaaaagcttcttaaaaagtatggagattgttttttaacaagtagtagagcgaggaaaagcatttccttcagcgagaacagtatgtgtgtcatagtcagcatgggcttacaaataggaaggcattgtagagtggatggcttacgcacaacagaatttagtttatacagctctggaggctggaaatcgaggatcaggatgtcatggataggttctgttgagggtcctcttgtgggttacacactgttactttcttgtggtactctcacatggctgagagctcagtgatctcttgtccaatccttactgtcattcaaaggccccagaaactttctaataccattacaccagaggggacattatttccatctgaatcttcaggaaaaactttcagcatacaaggcaaaattgcaagggcgctaagaatgaggacatgtttgagcaaagatgcaggatttcagggaggctgggatatgtgtatgagagtagctgtttatcaagatggggggattgtggctcaaccacagtgagcatcagatgctcacgcaaacactttgcacttcttcctgtaacctgcatagcatttgagcaagtgagtagggggagtaggacagtgtaattgaagctgattggagcttataatcagaccttactcgagttttggtaattggaaatatcatgaagtctaaactcttgttaaaactttgtggtaattgccttgtttgcagtgtaaatatagagtgtccattaattttgatacccattggaatgttttaatttgacagatttgaacctgtgaaattaaagacacaccataaatagcatgcattttgatgacttagttttgtagcaacttaattggccctttctcccacctcgctcctctgtagatctgttcctctcaagtttgcattgtcctaagtcaagctcttgttatttctctcctacaaacaggtactggcttaaaggtcacctaacttacatcacaggatttgtgctgtcaaaccaaatatgtaatgttttggctggattatagcctgtctttgaaatattccaagagaagcacaagatttgtgacatatgtaactgggtaaaatctagcttcactaaagtacttctattgtcatgtgtggaccacctaccacaaaataagctaatttggaaacagttatggcaaagcaatcttagcactgccctttactaagatacattgtcggcttagttttattactacaacttttatgatgagataattagtaattcgattcacatatgaatttgagataagaccaggtgaatagaaattggtccacaattgtatatatctgcgttatcaagcaaatatgtgcttatgtctagttcttatacaaacctacttgaaacatgagtcatactatagttgtggtggctattgttcagttgcttggaacattcgactgaagtgtgtatgtgtgtttatatgtgcgtaaatgtaggcttttgaggtttatctggtgtttccttaaaaggaaactcttttatttttcattttaatgggatgaatggttgtttggtgtttcagtctagctgaaagcaagtgttgcagtccttgatacaggactcactttgtgcctgacagctttctcatgtgagaaatgtgattcttgctaaatctcttctaagcttcccaggcacaaagcatattactgtaaacgaagaggacaggaacttcctgagttataaatacataaaatacatagccatatgaaaggcccttgtggaggggctcccctggtatgttgagccaaaaatactgtctggcctgttcttccccctcttcttactgatgttgccttgggaattggaagctcaataatgactcagagtggtttctgttttgtttctttctcagggacagccatatgtggtgccatgaatactatgcttcttaggaatgtctctcccagtcaggaccatatgacttcataccacagagttacaactgtcagtcaggagcatttcctgtgttaacctcttctcctattttgcttactaggatcgtacacttttcccatagatagcacgatagtatataatatctatcagtttccaaatgctatcttgagcttttaaagttaggaatgaaacactggtatttgttaggaagaaattgacgttagtagacagaataaaagtatgcgtcagcacttagtaagtgacttatgaatggctgggatttatacacaggaagggttaataatatgggacaaaataggctaggaactgagtcactaagaacgtcttcctgttcctttatgtgtgtgtgtgtgtgtgtgtgttcatgtgtgagactctcacacttgccaaggggcaaatattcatttagaattgcaaaaaaaaaaaaaaaacactttagcattcaggaaaccatggattttagtatgtacaggttcagaacttccacatatatcgggcttaaataaaagtttaagacatgggtctgtttcattttaaggaagtatttgctaccaggacacaataagttaataaacaaaatacaattgatttgtagaacactatcttaaatttcagtgctaattatcactacactgttgttttctaatgtccagtacattgaacaaagccatttttaaatagtactaattgggttcatatatttcttgaagatgtgtttatgaatgaacactgctgtttagagttgaaacaagtttaatattaagttgtatttccctaggcatatgttggatgagaacaatgaaagtattttgaaggcattagaaatatagttcccatttcctttaatgtcctcataccttttcatctagatttctctttatgcagatttgttaacagtcattgaaccattttgcttcaaagtcaccaggaaagctagctaaaaaatgtagattctagagcagcatgaatctaatgaaccagaattcagtagtgcgggcccccaagaatctgcattaataatctgcctaggtgattctgtactatacagtgcgacatccactgatgtcttagacggtttgcaaaatggtagtcctgcaagtcatttctagctcacagatttggtttgtttgactttcagtgttgactttaaagttttgcaatctttaagaattgggagttcacgtacaaaccaaatttctcggttctcttgagtcatcagaacatgtttacagtaatggctccatgtttcttcctgggttgtagtaatccactccatacaaatgaaatctgtgaggggggcatgtgctctagtgtttaacactctccccaccccctaacctgcatgtcagcctaagtcagttaactgatacttatttctctacagctgacccacatcatacatactcagaatttttatgcattcaggtcttcagctgcaggatccatatatttcaaatagtgaggagaaatgtttgcaaagaggtgagataggtggttggaaatataagagaagttagagtcctagagaaatgagcctccgatgctgggcactgagcctcttgagggggaaaaagaagagtatttgggaatgaacagtgttagtgattgactgagtttggggtaggaactggatgggagtctgaagaacagtgccatgtcctgcacagctccagggacagacctgactagggcagcaagagaatgaagacagataacacagacacacaggaaagcccgggtaggtggtttggtctctctgatggaaaaaccacagcatcctggaagctcagtgtgtttattacatgcagttgaagagagaagagggcttattgcacacagccggacaaggaggtggagttactacatacagttaagcaaggggccagggtttatgacacacaactaaatcaaggatgacaagtttagctaatctcagtgggagtagtctctgtaggggagcagatttcagattataaatatctgaggggagaaagctgtggtggacactttctgctcacactatcaatatctatacatggaccacggtaaggctttgccagccctctgggcctcaccccaggggttggagaggctttgccattcccataggtctgaggctgtgggttccttggtatggcccatggctgtgtctgtgtcaacagcacacacccttcaacacttggctcatgcaaggctttttcttctccctacaaacaggcacggtataatgttgggaggtgaagttgatgaaagacacaggacagtaggtggctgtgagacatcactgctcggtactgagatgttgcttgctgtggagggtggatgctcttctgcgttggagaagttgattcctggatggagtatatgagaatctcctgaagatatgtatgaattgaaaaagtgtgctaaaaaacctctactgtcttttttaatgcaagcaggagaaagaaaaatatctactcaattgtagctggcaagaatagacagaaaacagtgtgtcctctaccttaagctaactagggcagagatacatacagagtccctgtgtggaggtgtttgcaatttccctccaaaggggttatagattagcaaagattggcaattgcagtaggacaccatgatgacacagtgatttaataagagcagcttctttctggcaaatctgaagtttatcttctctttccctttatcttttctgcatttcaaatgctgctctgtgtgtattctttaatctgcagactctgggagcatgctgtattgtaagaagtgtttgccagactttttttttgtttctgtttttatctgcaagaaattgtttctttgggaacatgttctgaatggaggttgctttcccagggtagcagcacccccttttcgaatcctacttaatctacattgcagattagctgctttattaatagcatcagcctgatctgtggaagcagacgtgtgccatatggtataggaacaaagaaaaagtccctttctttctgctagattctgggctgaccctaatctatattttcaaatcagtcggtttatctttgtgcttctctaactcttctttcgtatcatggtgctctctgtttagaggctgctcctcttgctgtgactcccactccaacaacttgctacttcttcattgtccccagttacatggccatttcttctttccaaactcttcatctctgtgtagtcgcttaactcttaattatgaggaaagaacttggttattttaaaaatcaccttttgtggtatatggacataaatgcaggaaaatatcaatatgcataaaacgtaaaataaaattaaaacatctatatcgagacagtttttatgtagaataatctactcagtgacacattttctgttcatgcatctaatcgaggttggctttttttcttttctttttccaggtagggtttctctgtgtaatagccttggctgtcctggaactcactttgtagaccagagtggcctcaaactcaccgagatctgcctgtttcttaattgtgtttcctttggcttcctcagcccactgtatcttcaacatgatttatctgatgtttaattcactttgttgctgttttattttatttttgtgaatttcatatacaattcatgatggctaagtttgcttgtcaagttgacacatttgggaagaggtaaccacaattaaggaattggctttattggattgcctgtgggtatgtttatgaggcatgttttttctccagatgatagaaaaagaccagcccaatgaatgtgatgaataccatctctcaaaagctagctgagcatttcagatgagcaagccagtaagcagcactcctttatggtctctgtttcaattctttcctcctgcattagctcctcaattatagaaagaaaccctgtcctccctaagttgctttgaattgtgatgtttattactgcatagaaagaattttatataggaaagatatattatataaaatatatattatataaattannnnnnnnnnnnnnnnnnnnnnnnnnnnnnnnnnnnnnnnnnnnnnnnnnnnnnnnnnnnnnnnnnnnnnnnnntctgtttttgatattgtctattgacttccttctctgatagaagaggattaatctccctcaccacccttccttcctgttcttaccatcacaatacaattattactatttttagtttctgtgtaagagatcttcgatctttgtttgtgtaatgtgtactttatttgagacaatgaagataaatgtgagtccacctagatattttataattgcccctttgcactctatccttcttctgtatttaccaaaaggaaaaaagggaggagtcctgattttgcagtgtttccccatctccttatgctgaccaccctggtctggctagcctgtatgagaatggtaggcatgcgtgtatatgtgtatgtcgtgtgtatctgtgggtgtgcatatttacaagtttacacaagcaattgtgtacccagggcaaagattcgtatgtatttcggactttttgcgtgtgagaagagatagtaagggtcgacctggagtaatcaaaagcctgaacttgtccatactccgtgtaattattcttcagtttaaacactgttcctttaccttgatggacacgcattctcagcatttgcaatcactggtttttgtagcagtgtctaacttaaattctgaccttaaaggttctgtttattttttaaaagactttttttagaacagcaattttaggtttgtagcaaaatcaaagcgcaaggagttggtacataacttcagccttcacagggtacacagccttccttcctatgagcatcctatgccagtgtggggactttgttgcagtccaggaacctacttcagttttagctaaattgggtagaggactgcagttgctggatcatcctatgagtgtatttgagttttgtagggatttactaaaatacctttcgaggtggctgtatcaaggattgtgtatgctctgcgtctagtatttctttttcatatgtaatttccaatcattattatctggagagatgcctcagttattaagaatattcactgttccttcagaggaacccagattcagttcctagcaccaacatagtggctcacaacccatctgtaactccagtcccaggggatcctacattctcttctgacttccacaggcaccaggcatgcacatggtatatacacatatatgtagnnnnnnnnnnnnnnnnnnnnnnnnnnntatatatatatatatatatatatatatatatattctctttatagtttttacaaaatattgtgtgttattctattttagagggaggaaaggttttagatatggtcttactatgtagcctttgctggcttagacaccctgtgtagcccaggttggtactgaacttgactttatcttcatgtctcagccccctgaatgctgaggtatacatggtatacaccacttcattggctctgtgtataactctttaatatctattcttccactagttgatagggtctctctctttctttttttttgttaaatgctttcttaaagcatgccccatctttcattttctcagctcagtgttttgtctccaatatctgaaacagtgtgtggcattttcgcaagtatttctgaaattttattatatgtatgaatgagtgagctgatcaatcgataaaccaataaacttgatgaatgttctctttgccatttgatgaataattatgttgtggcttggtaagtttgtttgcttgaagactttaacatagaagacagaagaacaactaggtaaaatcatttggaacttgttaggaaatgggacaaaaatgttctccaaatgccatcttctgtaggtaaatttctctctctgtcttgctgtctttctctctgtgtatatgtgcatatatttgtatgtatttaagtattaaaattatatattcttaatttaattattttgttgtggttattgacttatcaaggaaaatactactttttctctgtccttctgtttctgtttctgtgtgatagtttggatgtgtgtgagtaggctcacctgtgtgtgtgagtgtgctcacctgtgtgtgtgtgtgtgtgtgtgtgtgtgtgtgtgtgtgttgtatgcatacatatgtgtcatgtcatgcaccttctattgcagtccatcctatttgtttgagacagggtctgttacttaatctggagtttactgtgtcatctagcctgactggccagcaagctccagggatccacctgtcaaccccacccccagcactggtattataggcctgcacttctatgcttggatttacatggttattagggctctaaacttagttcctcatgtttgtatggcaagtactttactcactgaggtatttactcagacaattctttctttggctatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttgcgaagatctggatatggtttctgataatcacgtatatatgtgtgtatgtaagtatgtatatttggagacaggttctcactatgtaacagtaactgatctggaactctatgtaagccagactggctccaactcacagagatctacttgcctccatctcctgagtgtcatgcttaagtatgtatcccaccatgacttactgataaattttatcatgtagaaaaaaatctagaccacatagtatttattcagactattcatttttgtggaacacaatagcgttgcagttgagcagttgacagtgaaccttagaacaaagactttcaatttaaggtaaatattaacttatgatgcgaggtatcattagtgtcacatggagttgaaagtgatagtctacagacagttactgctaaacttcactgtttttttgttttgggcaggttctcactatgtaataaaataccctgaccaatgcaacttatacaagaaagcatttaatttgaggaacctcatggtggcaggaacagctgagagcttatatctcactgtggaaattggaggtagagagagcgaactgggaatagtgcaggagtcttttgagacctcagagcccttccctagtgacacatatcgtccaacaagcccgcacctctcagtccttcccaaacaggtccagcaactgggaaccaagcatttaaaaatgtgagtctctgggaaccattttcatgcaaaccactataccatttaactggctggtgtagaacttgcaccaggctggcttcacaatcacagagatctgcctgtctctgctgcaaatgcggagattaaaggtatgcagtacctcaactggctaaactttattctctaaagaaaaattttctacgatttatttattttatgcgtatcggtgttttgcctaaccctacatattcatatgctccacatgggtgtctggtgcccatggaggtttaaagaaggtattggatcctttcagactcgcaatacagatggttatgagccaccatgtgggcgctgaaaatcagtgctcttaaccactgaaccatctctcccgccttaaactttaatctttatgactgaattagacatgttcttccatggtaatattcgttagatggtgaaaatttttcttctgtcagcattggcaatagtagccatagtcaaataggaagtggaacacacacacacaagatggaatgtgatgttctaccttactcttgttcttgcttcaagcttcagcgacctagaggagagtatttgcaagaaattgttcaagtaattaagaaaaagtctcccgtgtttccctattgatttaaaaagattaggatttgagggattaactactatccagtgagtacttatgcatagcccaaagtaggagtgttataatagaggatggtttacaaatcggatgaaaataagatgtttcctctttttcactttgtgtcattttaacaaatgttttctcttgtgacattgctctaaaaccaaaagatcaacctaaggggcttatctatttggagttttctcatttacagtgggtcacctatacaacactttcgttttgttagggcataaaaatctatattagtattttgctaaaacaaggaatgcaactcagtacagttagagattataaaaaattaacccatatattaactgcaaatatgtccaatcagtatccccagtaaagtctagatataaatactttcatatgtaatatgagaaagccacttccatcacactctgcccccttggatagttttaaaatttgagagggaacaagtgatgtgaatttgtatattctagtgcattaaaagttaatccttgtaaatggaaattgttgttgtttattagataccacaaaaactgacatacaataaaccaaaaatatttaagaagagcataatgctggcttttgcatatgtgcaaaactgtctccatagtcaaggcagtaaacatatgccccaggcttagatatgctatgcccatgataaatcctccaacctctattttccctttcatgtaccaagaatcagcagtttgcagttttctcaggactttggaagtttctgtgtacttgatttttagtaaaatacagtaataaaacctggttacaatattcttccttttaatcttaattatttgacttatcttttcaaagaactgttttacatttttcctacagtggttttattttcactcaatttttctgtttcttttgatgtttttgtttgcctaaggtggcaactataggtctttgagaacttaattttatgatgaagagatcaattgctctaaatccttcctagtgtttgtgtggcatcctgcagttctggtatactctgattttattgccacttagtttcaaatttctcgtttgtattcatctttgatttatcagttatttattagaattgttttatttttataaatattttgggattttccagaagtatattatgtatgtgtcatgaacatacttggtgccacaagtgggcatcagatcttctagaatagtggttcatgacttgtgggacatgacccctttgggggccaaacaacctttcacaacggttgcctaagataattggcagctattcatattatgattcataacaataacaaaattataattgtgaagttacaacaaaatgattctatggatggggtcaccacaaatacagaactatcttaaaggatttcagcattaggaaggtcgggaatactgtcctagaacttgagctcatgatagttttgagccatcatgtgagtgctggcaagggaatataggtcctctgcaagagcaacatatgctcttaactcctgagccacccctgtggcccccaaatcttttgattttcatttctttttttctagtttttatttaaatttgaaacaagttggttttacatgtcaatcccagttccctctacctcccctcctcccctgccccccactaaaccctatcccatcccctttcagctccccagggagggtgaggccttccacgggggatcttcacagtctgtcacatcatttggagcagggcctagaccctcccccatgtgactaggctgagagagtatccctctgtgtggaatgtgctcccaaagttcattcatatactagggatacatactcatctactaccagagtccccatagagtgcccaggcctcctaattgacacccatgttcatggggtctggatcagtcctatgcttgtttcccagatgtcagtctcgtgtccatgagctcccccttgttcaggtcagctgtttctgtgggtttcactagcctggtcttgacccctttgctcatcactccttcctttctgcaactggattccacgagttcaattcagtgtttatctttgggtgtctgcttctgcttccatcagctactggatgaaggcttatgtttgtctttttgtgactgggttacctagctcagaatggtttcttctagttccatccatttgccttaaaatttcaagattccattgttttttcccactgagtagtactctattgtgtaaatgtaccacattttctgtattcattcttcagttgaggggcatctaggctgactccaggttctggctattacaaataatgctactatgaacatagttgaacagatagatgcccttgtatgaatgtacatcttttgggtttatgcctaagagtgaaattgctggatcttgtggtagactgattcccattttcctgaggaatcaccatactgattttcaaagtggctgtacaagttggcaatcccaccagcagtggaggagtgttccccattctccacatcctctctagcataaactgtcattggtgtttctggttttagccattctgacaggagtaagatggtatctcagagttgtttttttaattctttaattactactcatatttacatatccatccccccattcccttgacctcccatcctcccatgttccccacaaacacccaatccaccctcaaatgctccccagggatagtgaggccctccaagggggaccttcaaagtctatcacatcatttgggggagggcgtaggccctctttgctgtatctgggctgcaaaagtatccctcctttgctcctccctccttcctctgcacaacctgattccagtagtatggttcagtgcttagctgtgggtgtctgtttctgcttcaaacagctactgaatgaaggctctaggaaaggtagacatcaatctcattataggggaagggcatcaatggcatcctctccattctaatacatttcttttgtggccagtgaatacactttctgtaacttaaatactttgacattcattgaggttgtaatttctagtaaatgaaccatacacacttgagaggggtacatattgctttgtattgagagttcaagttctctgtcttcttgctttctggctcccaattcctactaactttcttcctccatgttctatcagttgttgagagagaagcttaatatttttgagtgctatcgtggctttgtctgtttcatttacaggaataaatgatcagaattattaattctgattcctgattagttggcccctatatcattatgggattttttttctttcattccaggtagtgttttgttgttgaggctacagtgtctgacacaactacaatgacctttttataagtattatagtaaggtttatagtctttcatcttttacataccagtccctttaatgctttttccttgtcattaggttttagcaatttgattacaatgagctttggtttagcattctctgctggcctgcattgtgctttttggattagttggttatatattttctttttaatcaaattgtataaattatggtcgatgtaccttttaattatctttgatcttcttgtctttttttgctccttgggattttatttgtttattttttggcatgcttaaagtttcattttcatttgtatggtttgtgtttcatcttatcaagtttctgtagcacatgttttctggtggccatctctaatgtctatttgccattagtcctttaactgaattttttgcttagacattgggattttcctctctagtccccctcccatctattgatctacttaaaattcccaacatgtgggacaagttaaaaatttttaatgcttagtctactaattttaatatctggagcagatttcattgattttcttttctcattatagatctactttaccacaaatatggccattttttggtgcattaatatttattaaaacttttgttttacagataaaaatttatagtatatatttttgttatgtataaaattatatattcacatattatatatgcatatataggttaattgttttctaagacaagttctcactatgtagttctggttagtctggaactcactatgtagactaggctatcctcaaacttgctgcttctgttgacaatctagggttaagggataatggtccacgacttggtgattttcactttttgagacagggccttgctgtgtagctcaggctggccttgaacttgtggccatcttctgacttgtctccctagagtttgagttgcaggtgtgagccaccacatacaaattggattgacaatctttaaatggatgccagattttgtgtatttttccttgtgaagtgctagtcattttttgattcctttaattttcatattcctagatttttgccttatatacatgtgccgatagtatgttgctgagtagcagggtagattttccacaaatctatgggttgttttgttttgtctgcatggctccctcttttctattactgtttgttgtatgtactatcttttaaagatcactgtcctatgctgtctattgtccattaggtgagaaatcatttcatgaatatttacttctgggccaggagaggtgtcttggtgtgtaaaggctatggctgccaagcctgaacaatcccctgttttgaagcatgagttcaatccccaggacccacatggaagaaggagaaaacccggttctgcaagttttcctttgatctccacacaaataccatggcaaacatgtgcccccccacacacaattgtatatgtatatgtacatatacaatcaatagaatgtaataacatttttgaaaaaagtatgtctgttttatgtatttttcttttgaatatgcatgttagttgtatttgtatgttaaatcctatagtactaggagttatagatctgttttttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggagaactgaagatggaatgtaaaatggaacttaaaaaataaataaattattttaaaactgttcaccaagactttctagcattcctgtttaggcttcagcataatctttgggattcacctgaaaattggcagctcaataatgtccatacaggccacgtggcaaactcaccttattttgctcagtagatacttggcgattgtttgattgttttctttacaaaacttaaggtttattcatacaaactgtatacatgtatcttttcccagatttcaaaatagtttttcttacaaattttactctcttgggtcataaaatggtatctattcctttgtatttgctgattgcaatactctcttcttgtaaaaatatttccagtctttagttcctttaggcacaggaacacacttcaaggctaccagtaaatgcctaaagcaacagacagtggtcaacaacttaggtccagtaaggttaactaataataaagtagaataattatatcagcatactacaatataagttgtgtgaatgtattctttcttgaaagtgttaaggtgaatgttagcattttgttgctacagttgagcagaaactctggaagcagaagtacagatggggtgggattactgcagagcacagaaacaggaagtcagtcctgacaacccgtttctagtttatccttttagtaagcatgttttgctgaaccccataatgtttgagatgttttcacaatggatcattgtagaaaactcatatgtaactctaagactttcaaacatacttcagtttgcttagattatgttgactgtgtggctttaagctagaccattctcattcgtcatgctggctgtgagaagagaaggcagaagaaaatccaaatcactgttcagtaagaggaaatgttatgtttatgctggatgagtcacatcaacatggattttggcagaaaagtttctatcagtttgacaggttttactcctggctaatttacttcctgagaacttgcaatgaactactcggttacagatggctgtttctgaagtaatccttcctgatttgctttacatttcagtattttccctgtggaaactctacaaagattaaactatatagtatgtagactctagaagacattttagttttttttttaattcttacagattacttcattttgttacagatttatttttatgggttcttgatcaaattgataaaatgactttaatacaacaatccagaaggaagagctaggatccatttattaccatctgaaaaaaatgtcaggaaagtgtttgagcagctgagtgggtgagggagagggtcttttggaagaagagtatggaccaccaaggtgtgagcagaagcaggatccgaagagaaactagaaaggggtaaaaggaaaagttttaccccttttaccccctttacatctacttttgatgtagaactcagaaaacagagagcaattaagatctgtaagcaactgcatagcaagtgggaatctttggagagaaagggaggaggcagagagaaaaagagacacagagacaacaaaagacagagacacagagagaaaaacatgctgagcagagcatcaagataagtagccgtaggatttgggcttgattccaaagagaaatagggttaaagaaaagttagactcttcctattagaggtcagaaaagtaagcaggcttaggagtcaaggtctccaagcatcaccatggatgcagagatgtctaggttgtgtaagtacatatcccattaatcccatagttatttcttccattttatttacatatcttcagggagtgctttcctgactagatgattgataagtcaagttggatgaattcttaggggaaatgactactgtgtctttgtaatcttaacaatgatttggctagtttagaatgtctcaagaacccaaaaccccaaaactaagcccccacaaaagaatttcatctctccacccattataagagctagaactcagatctcagttttttgttcattgtcctggaactcaaagcttagatgaggctgtcctctaactcacagagatctgccactctcaagcactgggattaaaggtattcccaacttcctcatttaaaagtaatggaaaggtctgggtcagaaaataaaaccaacagcagttttacacaagctaagttcataggaagcaatcttctaggcatgcgacctttgtgctctatagcccttgcttgaattctgaaatcggctatgtaaatgttgtaagacagtagggtgggaacttacatgagtttccttctaagcaaggaatctagtaactgttccggtgctgatgagtttccgtctgtgcagtcaagagttgcactatataccatactatggtatttgctatgctttttgtgatggtgtgtttttggctgacatggtgatgttgtatacaggccagggaatgttacccaaggtggtttgatttaacttctttgtgcatatgttcactatccacaagtagaggtagtccctacattacagatgtactttaggaattaaattagagccctaacaataatgcctggtacccagtacttagtgacccttaattctcagtacccgtactgctgctgtttgcctctttaggtttcactaactttcctccaccctccatttgagcatgcaaattaaaaataaatagcattccctgttattgcccttcagattttttataacatcagcgattctcattccttcattctttccttttcttcattctgtcttgtacattgtcttttttgatccgtctcccttcatctcctgtttcacttcctttgctccctacgtttcttctatcctccactggatttatttgactttttgcattgaaactgggcagtaagaaaactaggccaagtctaaattgctgaatattgttttgtgggtgagacatttagaacaattgaaaaagaaccttaggtatgcggttatgtactgtggaggtgatgtgtcattattgatcaatatggagggccatctttaacccatttatggagcatattccaaagtataagactcagttctaacttgaaatccctactttaaagttggaagttatatactctaataaatattgtagtaaaatgtgaaccagggtgttggggttaataaaaggttgttttgtggtattttatgccctctttaatgccttcgccaaagcactggtccttgtcagctactgatgattgacgccacatttcttaaagttttaagaaactgctacttcttcaaagtctaagttacacattccaggtgggtattgtctgtagctttgggtctacatgtagtattgtttctgtatttcatgtgaaaaagtgcttaatttagtatgttcaattactgtattaaaaagggaagagcacattttagtattttcctaagataaatgctcaccattttaagtagcagtgggcttgtatatagtttatgaaattttagatcttacaaggtcaatggatatctgaaaatacagcagccttttaacttggtggatcaaatttatacttaagctcttgaaagagttcactctaagtactcttgaggcagtttttataaaggcatttagatcccaggatatttcctttaatagaaggggtgcattgccccgtttctcatttcagctactcaaggtcctagatttggagtgtgtcttcttctattcgctttctgaatactttgacttgaaataagtggccagttgtttttcttctgtctccttgtggaccattgttagtgcacccaaccttgcctgtaatgaagaaaagcatttttataacctgattctaattcatcgtttttcatagataatgttccaaaggacatcatagttggatctccttcggtcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgtgttgtgtgtgtgtgtgtgtgtgtgtgtgtgtgtgtgtgtgtgtgtgtgtgtgtgtgtgcaataatatgaagttgacctgtgaatttaaccatcatttgggagcttggttctgtaggaaaatacagcgatagaactacaacaaatctcatggctataaacagcttatgtatgtggaggatttctgtagtatttattgattatggctattaaattagtcattttatatagagtaagtattccatattagaaactagaattataatggtgagaagtcaatttaggtattttgtaaaattcttggctatccctgtctttctggcatattaatttggggccaaaactcaagataacacagcaagagaaattctgtaaatgttgaagcacatttatattttcatttcagtacactgactgttaattattctatcagttgtatgacatttaagttcaaccttctagttcctaattggccaaactgttatcagtccaaattatttggcattgaagaaaataagaaagtctacagaagctattaaaataagattagaacttttcaaatttatcctggagaagttagactttctcttgcattaaaagctctctctctctctctctctctctctctctcacacacacacacacacacacagagagagagagagagagagagagagagagagagagagagagagtactattagcaagtttaatgtggattaagtgctaggtgcaaatatatgatacacatccctgttaaagcttgcttttctggttgaaatcctttgttggcatcggtaatgttcaagaattatggaaggggttaatggactcttcatattttctggctttatctaaactgtgttcaatatattgataaacaaccccactgttctaaagtctagggggcaaggaagaagagtggtgagttttcagcctgaatatctttccactaaagcatttaagtgtttcacagtattaaaaatactgaagtcatttgatttgttccataaatgtgtaagtgttatcactttggttctgaagttttacagacaaagggatgtgcaggtcattgctttttattttatacaatgactagactacatatgatgccttgaaattcaggtatagttgctgttttattagctgttattatctttctatatgcaaacatccaaatttgtgaagagttcattttgacaagcacaagtttagaagaaatttgtgacctgtatgagtaaacactaattcaattgttgtttgcctaatataataacatgtccaaaatgaaaactatctggtaattctctatgatggaatttgtaaatcatagtagtttaagtgacatttttggtatatgctgtttattattttgacagtttctcttggtagctcagaagtgaatgccttaagcaaattaaaactgagttaaaaattgaaaataaattcagaagtaagactcagtgttagacaaatgtgtttaacagagctaccactattgagttaagaatctgtagcctgtcatgagaaaaatcaaggataaatatttgtatacatttttaaaatactgaattcttgcaaaactttttttagccttctgaaaattgaattacttttggctatcatatcatcatattttcctcaagcttcttagttttaaaatatttggcaatgtattgttctgaggttggttttctaagattctctttttaaattcttgtgtgagtctgaaaaggctgcctggctttctgggtactgaagaggtctgcttttagatggaaaacatggctttgagttgcacctttgaatttgtgtttcccaagggctaaaaacctgaactgaacaaacagacttttagacttgactcattcctgaattgtggattgttaggaaattcagaaatatcacctaaaagtactagtaatgacattaacttaaattgttggttgaattttatgcattctccctataaaattaggtttaataataacatattcaaaattcaggtataattttcagttttaggcaatttatactcttgaagctttgaaggagtaaatcattttgttttgtcagattaatttttcagctatatcggaaaactaaatgatgtggttatttataaaagcttcttgaaggagatgcatggcaagtcgttgtaaggtgaagtatctagtagtagtaatcacagccatttagaggttatttgtgtgttgtaaagatagtaatcacaacagcatatatttaaattactctatttaatacaaacaacaatcatatgtctgggtacattgcttcaacaacaagggtaattttaaacaaaattacatatactaacagctttctctgttccgtttgctaccacctaatctgagctcttatcataacaattggatctcgttttctttccatcactgctccttttcccaggcccatttccatcagtcattacaaatctgaatgttcactcaattctagctactgtgtaaaatccccgaggataaggtgggaacaaataaggatgagagctagttgtgagtttgggtgggcttgtgtgtgcttgcaaatccagaattggggagagtgaggcacgggtattggattgtgtgtttgagacaagcttgagctgcacaggaagactgaaaaaaatgacagcagtaaaaaccacaaaaagaaccagagagagatatgggtagagatttatctataggcagagaggtggaagacagacttttagtcctgagcacattgagtttccagtatagcaaggaaggcaataaggaataattgtaatctgataattacaaaagggagaggtcagcaaccatgcgtcacttactataagagaacaataaccttagctaagagcagaaaggatgaatgggagatggccaactaaagatgaaagagcagtgatgtagaataaggcctattaagtctagcaaagaggccagggaaaggccaaggctgacaaacaagctcaagatttaaccaggagtgttatactaatccatacggtttactaaagtcttcaaaatgagatcgaggtttcagagtatggaatcttaatcatatggcttaaatgctaattaaaaatgctaatgcaaaatagaaaaataattctccatatcattattgtgggggtttaaatgaagcaacatatataaggctcttaccattatacctagattgaataaacactcagtagagggttgctgttacatacatagaaaagaccaagcttgctaattattgtgtctttgagtctttcctcagtcagttctgaatatcatagaatatcatctgaattgctaaaacctgtaaactctgaaaatggccttttataatttggctgtaaaacttggcctacttaaatctgcatgtagatggtatttttcctgtttggtagaacatccttgttttattgctgaacttgaatgcaattcagtatgctactgtgggtctttctgggtatattttgttatttgttgtacatggaaccatgtttctcaaaacttgaattatttggaattccaaaacagacctggttccaaaattccaaagaagactggatccacgccatgcaaatttagcttttttaaaatcatcacctctccaatatccttctgtgaatcaggaagtccttaggacccctcagggttgctaaatgttttgtagattaccgcttgtggttttcaagagtaactctaatctgaccagagtcacatcttgaaaatgtaatgcccttcctcttgaaccttttgtttcctaaggccactcctcccaagtcccctgaagcacagagtgctccctcttgtgtctgacttccttccctttcccccctttcatgactattcctacccagggattagtgtgtgagtcttagcagagtttctcacccacttcagaaatggttaaaccatttcttcctcttatacttaaattctttttgtccttaaaagaatttatccaccaaatatttgaataggtattaggtgccaatggttgttcaaagtgttaatgattagaaagctaagcagactctcaaaatctctgctgggagggaaattgtttgctagtaagtagaatgcaacatgtaaattgtgagcaagttcttacagatagcacacaatgctgtcttgattttagaggacaatgtggtagggaaggaaaagctgcataccttagagcatagtatttcgttattgtcttgtttttatgtggttagttatctaacttctggttagactgcacatgtcttaagggaggagtcatgtcttatacttctatataccgtacaatactggttgtttaataatgggtaactgcttaatgtttgctcaattcattcatccattggttaacagagcaggtaaaattttatttattaaacattgctccccatttggccaacacatcgatccaagtgtaatctaatgtactaattactgctttgaaagattggaatatctgtatttatgtaaggctagatttttctagtcttgttttttgttaaattcatagttcatgaaggaaaacccttcaggttgaattcttcctcctatctcagatttagtacatagcaaacaaatgtaatttctgtgcttgcagaagcagctcttcctataaaaagcttgattattcctgcaattgtttttgcttaatttagacattaagtggctttcactaattcattattaggagcttttgttgaacacctaagtgaccagcatacatttcctgaggtgcttattcaatggaagagactgttggattcccatactatagttattgccttaatggtcaagtttggtacatttcatttcacattgagctcatatcttgttaggacagacgaacaatactaatttaatacagtaccagtattttgcttcatgaagaaaactgaagctctggactttgatgttatatttgatctcctatatataaatattttattcttctacaacgaaagaacagcttgaggagcagatcccagaaggatttttttttgtcagaacaatgacagaaagaatttttatttgtagtagtaaaaattctggcagcttaaagtttgaatcttcaacttgacaatatttctgagatggcatgcttactgtaacaaatatagaaacatattttctacttaaatgaagaaatggatggttatagacattagccaccaaagtagggaagatatttggagcttaatgtcaataagttcatcttctcttctgttagggttttgacctttgaaagcagggccatgcctctttaaattttcagtgcttagcatgctgccagttcgcctagcatctattcataaatgctaattgtgatggaggacaatattgccaaacatgatgtgttctgttggaaaatgacccttatgttagaatgtagaagaaagaataattgagggtaattttaaatacaggcagtaaatatttccatgatgttgaaagctaaaatttattctcctgtcatcctagaagcaaacatctacgttgagtttgcttctaaaaatcagattatagataattttctccgtgaaataaatagatcagagagatactaaactaacacaatctccatgaaggatttcagtgattgctcagaaggttgattttgattactaggtattcaaatgacctggaattattttgattggttttgctagctttgaaagttcagagtatagaatcttaaaagttggaaggcagaactacttccttctatgacggctaccaatttggatagataggaattaggcagacacgccttgtagaggaatccaaccctgccgggtggattttggctctcttgctccccttcctcaaggtctctctaacttggaattatgttcagtctgtaccaaggtactcctttatctgaactcccacggcatttcccctttcccattttttttttgtgattgttctttcaatcctctgatcactaactaactagaacctatatagtagatgttcaaatatttgttatattgatttgaatgtgtctttctgtgttccattgccctggcccttttggagagcaagatacttaaagctgggtgaataattgaccattcatctttgttgtaatggccagcttattgattttctttaaaagagaaaaaagttgtcaaatacagtgattgagtttttgagttgacgatgagacttttgaattgcatccaatttagttgtccaatttctgtggtgctagactaattgcacaatgtttataaagcattgtatttccatgtaacattatccatgagagagttgactctttacattttgctgcttttgttaatttctgcctgattgagaaaattaaaacttaattttcttgcaataatgatcttttgtatggcaatcagaacttcaacattagagtttataagtaagttcaccatttcttgtattcttaaagggttgagactctagagcaatacttttataattagataatactataaaatactgcactgttatatttaatatagctcatcataaatgaagtttaataaactctgattgcttgactaatgcgtactttgattgcttcttcagagttgaatttaatgaaaatatatggtcactatacttattgatgtaatatgtactgtaatgaccattatcattagatttgcataataaaaccttaccaaaatgactttaatcagtgcttttaattcaagactgtgattccatttttggggggtcacttttttctttcgttttttttaattttttaattctatgtatatgtatagatctatactttgtacaaagaagtaagatacatctttacctccatggcctgtgggaaagatatttcagtctatataaagtaaattcagaaatgatttgagaactttttcttaaaaaccacttagaaatgaagtgtttgtctatttattttaaaataatgtttttctgtgctgagggcctaactcatagtctctcatacatattcggtgaatgctcaaccactgtattatactgcagacaggctttctttgtgtatcccttgctgtcctagaactcttgctatgcacatccggctggactcaacctcaagagattcacctgcttctgcctccagaatgctgggattagaggtgtgcaccaccatggttggttgtatgaaggtgtactttaatacaataattttaaaatgtgtttttaatatcagttaatatgtggaccagaaggtagagagcacagggtaggctcgctctcacatcttttctggagagggatgccacggtggttcttgactattatctgtgtaatttgttccaaaataaaacagctatttatcgtttatcttgggtctagtgaactcattaataccctaccttcactgattatataatattcttacaaaaaagagaaagatcagttcatatgaacatgattgctttaaacttgccccaaaacagctctttacagttctttgaacttcctgtttggtgtcgttttttgactgatgttcagtcatgtggcagaaatcatttattttctattgatgaccatttgtgacttatactatgatttcagcacattttcgtatacagtgatgaaaaatcacaatttctgaaactcaggtactttgtgtctgctaaacattttcctctttagcataccatggttatttccctcacacaatttaacggaaagttttaaatattattatatttaggaaatatgccacttgtcaagtcaaaattataactactttttattttttttatgtgcatatgcatgtatatgtttgtgtgattgtctgatgtgtgtgtgcaggtgtctgcaggatcagaaaaggtgttggctcttctgtagctggagttataggagaacctcctgatgtgggtgctgggtaccaaacttggatcttctacaagagtagtatgtgttattaactgctgagccttttttctagctcttgaaagcaaatattttagaaaataaccatgttacagtaaatgcgcccatttatatagaatgtatttgtgtagtggaataaaatttataaatcaagaaatcaagagcagagtgttttttctttatggctctctatcataagtaattgagataattttttaagtgtatctaatttgctttctcccttggggtgctctatcattcttgaaaatacgtattagggagaaattcttcaagaataaaatagagcagagtcgttatccagttttattttaccagggttccacatttggtttgccagtagtcaaaatttaaatttaagaggcacctagaaatagaaatagaaatttagaaatgtccttctaaaatgaatattccaggtcaatggatgtgcaaaagtacaaacaggacatcataggaatgcactacacaaaagatttcagtttttgtattatgtagtacaggggtcagaagggaagaagtagaaggtggcctggggccaagtcattcagagcttgaatgcctttgggttattagtccttacagtagcatgaggcattaaatatttataaaatggaatatgagagtcattcataatcatattgagccttagtgtaccaagtattgttttaggcatcagaaacagagccccaaactagacagagaagaaatcatgtccttatacagctcatattatagtgagcagaagagatactaaatggttggggctgtaagctcagtggaaaaacgattgcttagcatgtacaaagccatgggttacatccccagcactagagaaaacaaagcaaaagccaacagaaaatgaataacaatatattgtagattggtatattagattttatttgaagaatgaaaaaaaaacacaagggaatgtggggattaggcccatattattcctataacagtattaccagagtaggcctcactgagaaaaaaatcattgctaggaggattaaggagcaagttttacagataacagaaatgaatgttgcaggcagagggaagagtgaattcctgtgggtgattgcttttcttgggagcagtgaggtggttagtgtgaatgaagctagttgaatgaaggggaagcagtaagaaatgaggtcatgggtcttgtagtcatcgtaatgactctgaattgcattggaaaggaaaatagagtcattgcaggtttgaacttaggagtgacatgactttggttttcacagtataatgttgtctgcccttttcaaaactcactgtaagagagcaaagctagaataagggagacaagataggcggttactaaggaaatctgggtaagaactgatggtggcttgaagtagacttttagtgtgtgtgtgtgtgtgtgtgtgtgtgtgtgtgtgtgtgtgtactgaacagttattctttagggcattggaaatgaagaatgatgatatgtggaggtctttaacatagaccaatggaatacagtggtaccattaacacaaatggtacactcttatttgtaaaattagttcttttgcttggattatcttaaattccacccaactttaactgtccatagtatgtggtttattgtgaacaaaaagaatatcaactcaaaatcagagaattgtcagaagattccagattcttcctgtcaaaccaaatgaaaagatagctagcatttcaatttttcttgtgtttgtctccactgattaaattgtcaacatgtgttcaattgagatacagatctgaagcatttctggcatatatgtaccttaacttagggaatttgactaaagcaaatcatttttcttctaatttatattcttcctttggagatatagaagtttccaatcataactttataaccccaatggaatggaagaaaaggaaagcagaagttgtttaaggagttatgtaatctatctcagaaacccagatggacaggctcatgtcagatgttagcagggtcacttcaggtctgtaattgtgctttactaggaatcaactttatcaccatgcatgaaggttttctgtaacccaccataaaaactcaaaacgaaatggtttgtgcataaacttctaaggtgaattaatcttttagagattgatttagttttgatataatctccatttttatcttttgtgcttatggatgatgcattcgtgtgggcgcctgtgtctgtgtgggcacatacatgtgtgtatgtttgtggacacatgcatgtgtctatgtgtgtgtatctgtgtgtatacatgcattctagagcatgttatggatgaagggaggtcagagaacatatatttgggtatttctgggcccacacctctttatcttgtttgctgcatggttagttggcctactagttatcacgggttctcctgtcactgcctgtcattttatcgttagagtactgggataatagatgcaaaggactgcaaagtggctttcaaacttaggttttcacatttgtttagtgagcgcttggcatactaagctatcttccaaccccctcttttcttttttcaaggcaataaagactggttgtggtttatgatgatttagtacagggattagaagtttaaactcctgacagaatcaaagaattcaacatacaaaaaaaaaattctacgcatgcactnnnnnnnnnnnnnnnnnnnnnnnnnatttgccacagctgttctggggaaaggttatctttaatagcacagagaggataataaaaattgtaggcaatttcctgagatttttgagaccaagcagttttgacttattgaaaactcacaatgaaattctctgcagtgaaagcactgtattttacttagtaaaaatacatgccaacatccatgaccatgtaaaatatactttattcagcttcttctgtaagaaacaagattatgaaacaagtcagaaggactaaattcaatttctaaccattgtggatcggttctttcctctctctctcactctctctctctctatatatatatatatgtatgtatatatatattaattattttatatattaattaatatacatatattaattaaaggacatttcaatgtactgtcatgtgctatatgaggagtctgagccagagatgggactgtacatatgatggtgatcctgtaatagtatatcatctaatgacattcttgtttgcttaagtttgctctttgatgtttacttaacgatgaagtcacttactgtgcatttctagaaacatgtcatcatcatgaagtgatatgtggctgtacttatgtagtgagatctaaaattcatactgactgtatgccattgtaagattttgaaaaaccttttgaatgctgaattttattgaactgttagtctttgttatattttaatattttactctaatggtggctatatgtgacattgttactgtttttttgtcttcatttaatcacctataagaaaatattcactgccaaacctgttcaaagactgtcaagaaacataatttcactgagtcatctgtcatcttgagcatggttgtagttttctctgagccagacgtgaaagggtgaatcttaacattcatatttaaaaacaaatagattactttcccccaatccaaacttcatttgtaattcctacattttaaaaaaaatttgtaatggttgtattatttgaatgttgaattttgtaactttttgggcaatgtacattttgtaaaagatgagaagcatttaatttcttcagtcattgttgttttgtttgatctatgaatttcatttatctgactgttatttcttttgtttgtttccttttggttttaatagaacattcaaataaaaactttggcagatgatgtggtaaggtggagtgagcagcatgttattgtattgcttatgcacgttacattttcacttaaaaatggacattaaagcattgatatatgcagcatataaagtgactggatgtttagaaaatagaacagaataggataattgccaatagagcaatttctcccttttcacacattaacataaacagttgttgtcaggcacagtggtgcatacctgtaattctagcactccaaaggctgaaggaggattattgcaagttggaggtcagcctggtgtccataaggagttctaggtcagctagggctaagtagtgtctcaccattcctcaataaaatgaaacaactgccctaaacttacataaacagctgggtcatatcccagatcaattatttctttatctttgtaacatataccaaagcaatattttaaagttttgtgcataaaggtggacgctggaaaacctggacattttctcttttgatagccaaataaattgtggatatattaaataccaatattggaggaaattgtttacaattcaaaaataaattaagtttattatcttagatatgtgcttattgaattttaaaagcttatatatattttcaagctcagactacaatagtaattcttactaaaagttgtaagcaaatatttaaatgtactctttttacttaaactttcttgaataatattttaaacagtttcatttttttgtctgtttgaagttacctatcaacaaaagatgtaaaataatgttactgctctaaggagatgaaagtatacaacttgacttcatcttcttacccaaatacagctgaaagacaaaggcagtttttgcattaaagtgaagggcacagaaatagcaaatctatatgttagtaatgctgatattcagtacagaagcttagactgtataagtattcttcagtgatatgaagtgagtggctaactgcatatttaaatgctttcatgtccaccatctctttccgtaaaatttgactcagtttatttgggattactaaaattgtttttcttgagttgtgggaaggaagacactacctatgtaaaccaacttaactgccctcaaagacatacagtaaaacccaataatacagttcaaataattttaaagaaagaattgtaatgtgaaagctgagatcagaaccatggtctcttgtgtttgagtcacctgttctgtgaattgaggaagtaggtttagatgctatttcatttttcttcccacctccaaactattgtggtttctataatctctctgtaagcaaccacatactcaaataatttttgtaatcctaactaagctgcttaaaactgctgtttttcaaagtacacgttatggttttacaaaaaacattgtatctatcaataaaatgaagaatatgtactcttagggggggtcaacaaaattttccataaactgtagtgatgtctgtaatgtttttgtattcttaaaggttacttaaatgaagtgtggtcatgtggcagtgttcctccactgtcctcatagctaacatgtctgcttgcttaatgtgacttgatattgcatgtgcttcctaacagacaccagaataaaactgagttgccttcagttttatgaatattactaatgtttgatgtcagatatttgatggcttttaaaccaaatatcctcttgacttgcaagcaaagtccttgacttacttgatacgaaagagcaagctaattgttagagattgtacatggtatcagtggtttaaaggaaatacccacacatcagaatagtatttggaggaggaaggtatttctgttttcgtttccaacaaatgcagaaacagccaccacaaaattttgatccaaagtgtctcttcacttccttccttgtaaaacagaaatgacaagtgactaaattttacttttgaggcatgttttttctcccccagctttctgaagcttaggaatgacttcagggttgcaaaaacagtccaatctctaactggagcttgctgcttacaataatgttttgtcaaaagagaataacaatagataacatactaagtgccattttgatgcttccattcttaatgtgcctggctcctgatctttttctgagggctttttatttttctgtttgtagcgtgatcgaattacaagtttcagaaaatctactgtcaaaaaagaaaaaccttttattcaacatcctattgattctcaagtctcgatgagtgagtttccagtggctcagccattatatgatgaacgatctctgaatttgtctgaaaaggaagttctggacctttttgagaaaatgatggtgagttcgacctctaatttcattgtcattttaaactgtgtatgtctagaatagattttaaatagggatgtttgtagttgactgtttatgtcatataaaagacagatccaactcttgttaaaaaaacaaaagtatttccaagagtacctggatttgtttgtttatttatttgctagaatgcctatctgttctagtcagagtgcctaaaatcagacacgggtttattcctctttgtcttgtagtattttgtggtttgtggcacaccaaatcaatttttcaattaaataatctgtgtgtttgctggtccaaagcaacatgtgtccaagtctacatgatctgttgagtagatgaaatatagttgggaaggcagagtgtaaaataaacaacaaaatggtaattggagccaaggaattaattcattctattttctcatatcagcaagagtcatacaacttacagtttgtagggtgtttcttaattttttctttgtgtgtgtgtcctctattatttctaaaataataaatgtaatacttggattattcaatactttatgtctggagcagggataaatgaagtattgggctatctcacattggttagcttgaccagatctcttttagagataccaaacattctcatctcccacatcaacatacattttatataaagactacaataacatttgtagcatcccttcctttgtcaaacaaaccctagtctatcttgtattattaatatttctcagtcactcaattgttcctgtttccgattccagtgtcccgtcttaattaccagaaatgttagaacccttctggtatttctctgcttaattgatgaaataaaatagaaggatgagaatgaaattttcttgggcctctactaccacatgtaccttgcttttagactctggactaattgctttgcttcttgttaccatggatgaaattttcatgtccaattctttattattattattattattattattattattattattatttgctgtatctggtttgcaatagaattcctccatagggaatgggctcccaaagaccatttgtgctctagggttaaagactagctccagtgttagaggtcccatagactgtcttggcctcctagctggcacccacattcagagggtttggcttggtccagtgctgtctccccacctttatgactagggtctccatgctttcactaggtcaggtcaactgtttctgcgagtttctgcagcaacgtcttggctcctttcatgtccgattcttatatgtgtgtatacatggagttgccattctttttttacctacttagatctttccccccttccattttattcggtgtatagctactgttttgcctggagtcattgtgtatgcctgtaatttcaatgctctggaggctgagggaggaggatcatggttaaaaaactagcatgcaattcatagagatattgtatctcaatccgttttaaaaaatagttctattcctactactttcctccaagttgcacacatgccttttatgggcttgaaacactatacaatagtgattcttaataatttgtaacttgtgagcactatatgaactattttataacctttcataatcatgttttatcatttaatgttaattctaatatttactacaatattatatatttttaaaaaatttaaatgtgtgaccttttgtagaacaatttgcttgttggattcattaattttatttaagcaaatgtataagttagtactacattttccctagtggaattgtttcattccatagagctttggaggaagatattaaacaaaaatatatttcataggaaatataatattgtgttattatttaatttgttgtatatcatatatatcattttcacctacataaaagtattatatacttgtatatcgacaatactgtttttatatccaatggtgtgattacttggttattcgatttactagtttgatgatgacgatattattttctatgacaatgataatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtagttttataagatgtgaaaaacttacagtcagtaaatgtaagtaaatctattcagagagtacatatatttatagtgaatatgttataaacatttgtagcattttttcctttatctgataaactctgatcattgttcagttgccaacatttcttaacattttactactttgtcacactgtcttgatcactgataacagaaaaacagaaacactgatatatgtgtgaatatcatttataaataaacacactactttaaaataatagtataaatgcatcaggaatagcttttgtgagaaacatcgtttgattgaaagttaacaaccaagataaatgggaaactttgaaaggattatatctattctttgagaaaagttttcttaccccttgtttgtattctatgtttaatttaccaatattgccttccaatgaacatgttcttttcagaatcggcgttgtttatgtttactataagttcattgcccaatcatgaaactattttacatgtattatgccattttattcttatgactgttcttctaagtgtgtactaattgtttgatctcatttccaaataaggagattgagcttcagagagagagagagagagagagagagagagagagagagagagagagagactaagaaagttggttcagtaacttaaagctattaagtgggcatactgatacacacacttaggtacacaataaatctaaaacattggaattttggtgacatctatatttaccatttcattaaagctatatatcaaatcagtacgttttggtgtataaatattgaggagatgcataaggtacgagagaaagggtctgagatgtagcattttctgcagatgacagatccttatttgcagttgccctttatagaacctcaccaaaggccaacagccttataatagaaagctgttgaagtatcttcatcatagttgataaagagaaggcactgaagttactatttctgaaacacagaagtaggctttgagatatgaaatttctgtgatttcttcactacctgtgggtggcctccttacaaataatgtaaacaaaaatgttcttgtcttatttgatgattactaaaatgatctggttagtgtctcttgatgttccctttattctattgtttctcttagtgaatgtttgcagtttccagaactaccatggaactgtgtcaccatagtataaaagatgtgtttggatatttttgatgacatactgaaacggcatcaaatagcacctttcacacactttttttttttttttttttttttttttttttttttttttttggtttttcgaggcaggctttctctgtattgctttggagcctgtcctggatcatgctctgtagacccggctggcttttcctgcctctgcctccagagtgctgggattaaagtcgtgtaccaccaatgcctggtttagtttacaatttctaatgcaatggattatttaacttttttttaaagaaatagaatgttttcataaaatttatggggaaaacaataaaaagcaatattcaaatttattctacctcattctgataattgatagttttagtgcttgagtatcaaaagtaccaatagcatttctcattgtagcagttattagaagactaagtttaaaattacagcagaatagaactttcaaaataggtattagctattttattattaatcattccctaatactccccctaaaaccaccttgatttattttgaagttaatgaaaattcttaaatgagagggctatctggtatggcaatacatgactgtaattgtagcattcaggagtccaaggtaggtagatctcgggatatataggaaattatatgtcagccaacagggtacatactaagattcttccttgtctcaaaacagggtaagtgactcacttttactttgaatgttttcttgactctcacatttactctgtgcatccataaatcccttttcatattatagatatttgcatatttgatgtagcaaacataagaccatcttaataataataccactgtctgttgctgacagatttaaagatctcacatgttatacttttcggtaattctttcataaagcaaacgctctttacaaacagtattttttgtattatatcgatgtactttgcatctttggcataatttaatgatgacatagttacatgtaataagtgcttaattattggtgtttttatttcacctgttagaattctcacaggtaaatctaaatcttttaatcttgttcttttccttttctccttcattaatttacaccgaagagttgcctctggacaccaggtgctctactttaacccaagcgtattgcattcccttgattgctgttaaaggatatttttttctcactcagcaccagggttttagaagttggttagcttggctgagaacctttgattgcgctcagcgtaagtaattttaataacagttaagtttccataaaatacattattggtaaactaggccttcacatctacaaaaagccatggaatagtgtcggaaatgattagattctaagaaattgttcagacagcccaattgccaccagttacatttaaatttcctacattctttcccccatattttagaccgtgctccacattttattttcctgtgaagaattgtgtggaaaacatgtaaaggagtagtggcatgtactcagaaaacagatgtcaaaactaatctggatctggatcagtttaatttttgccattattagtatcacaaaaggttcctgagggaaagagaaggaagacaggtattgaaggagaaaaaattaaagaactaggtttgcaaattgatgttgtagtgggacaaattcaggaaccactgcttttttttttttttcttggcctgcatttggaaatgccttgaaaataagtacctttataaaaaagggatttttttgtgtattctttatgaatacattttagcaattatgagttgatctgtgttatgatatagatggtatgctatgggctgcaggtttagaaataaatgtagcacctacttttatccacagagagcggagttcagtcacatagacaggtagctatggcgtccctaaaattgaggctagctgtggatcagctgctttagtgggagatataatatagtcctttcagcctctcatgggggctcaggaaagaagcagatgtagaggtaaggaaagtgtgaaaagccagtgtcaaattctgaattttcagtctttgtttttctggcatcagtgccttctcattgtttgaggaattcatcaaagttcaagagttcacttgacactagtgtgtgtgtgtgtgtgtgtgtgtgtgtgtgtgtgtgtgtgttgtgtgagtgcaggtaggaatgcacacattctgcagtgtgtatgaggaggaggttagatgacaacttgtaagatttgattttcttcttccacctactataggttctccagggcccaactcaggtcaccagacttgtaaggccagtgcctttccctgcaaagccacttcactggctccatgctttatgttttaaatggttaaggagaagagtgtttgaaggtgcatggaaattacatgaatttcattgtctacagaggagattttttttgtggaatgcagctatgtctatttttaaattcctattttgtgtctttgtactgtagcaaaaattaattctggtttaggctttcctggcctatatagagaattcaaggctaatctgggatacgtaggccctgcctcaaaaacttaaaccaaaccagagcaaactgaaacaaaataaaaaaataaaaccatgcccagaaaagaataaaaagaaagcagagactattaatgaggaaagtctaaaacacttattaccctgcactgacatactacagaaaagcattgtaacctcaggaatgattcggtggtctttatgctttttgatttttcttccccatttgggaatagtatatatataaataaatgtatgtgtatgaattcatttgtatatatgtatacatttttctgcatgtaacctcaaactgtctcattttcaactatgaatatatgcatatgctaatgttatgtaccttataaggtgaaggcatattcaagattgtgaaaaccttgaaggaatgagattgtccaatgaatatattttttcagacaaaagtcttcactttcatgatggtttttattgtgtgctgacagtgagcccatgttttttatgtcttgttttaaaataggcagcaattagacatctttattttgatatttggcactcaaagccaaaagctgacaaagaagcccaagttcagggctgaatagatggcacagtgtgcttttcccgaggacttggtttcaattcctagcacatacttgatggtttccaaccatttgtgactcctgtctcaagggatctaacatctgcttctgatatttgaaggcaccaggcacacacacatggtacacagacatacatgcatcaaaacacatttaaaaatacataaaacaaaatgctggtccaaatgcatcaagtagatagttagcaaaaactaaatcagaacattgacttaccaatccattccattaatcaagcttcaccaggacaagtaaattcccttcccctttggtgacaaccagttgtgcaatgagtatggcatgttatatattaaagtttctacattaatgggttcaaatgttctttagtgagagagtctttaattaatgctattagagaatagactctttccattttcacttccgtgtcattcatatatagatccttatcctcatgagtgtctcctccagacagtatctagccctgagaagaaagaattaacagtgattccagcagaagactgatatggaagttgggtcagccaatatgtgtcaatcaacatgaagttctttgaaaagaagttactttctaactgggcactattttgttaaattaaaagagaaatgcctaaatcatggtttaaaataatggtgcaataaccagagatgtgtttgtagggagaaaatatattctttctttttaaaatgtattttgaagtattcatgcaagtacagattgtatgtttagcatttaccctccctactttcataccttccctttttttcaatttttttaaagattttatttatttattatgtacacaacattctgcttccggtagaagagggcaccagatctcataacggatggttgtgagccaccatgtggttgctgggaattgaactcaggtcctctggaagagcagtcagtgctcctaacctctgagctatctctccagcccccataccttctcttttatcaacactcccagcttatactagtccttttgttccccatgacagtttcaagtctattttcatgtcatgcacatataggattttacacatttatataaactttcagaaccacaagtgaggggaaacatatgttggtcattctgacattagcttacattatttactatgattggggagaaatattttcataattatgtaaatattttactgtatttgtttcactctatctaaaatagtttatagttgtttcaacacacacacacacacacacacacacacacacaaaactagttggaactcatcatgtacccgaagctggccttgaacttgtggtcctccttgtagctccttgagtgcatgatttataggtgtgagatattacccttgctggcttgatttttttttttaaattttgtctttttctgtaaataaaagctgacttatttatttgtatagcagtctgtacactttggtttaaaatactgtttgagttgctggtcgttggtggcacacgcctttaatcccagcactggggaggcagaggcaggcggatctctgtgagttcgaggccagcctggtctccagagcgagtgccaggataggctccaaaactacacagagaaactctgtctcaaaaaaccaaaaataaaataaaataaaatactgtttgaattttccacatgtaagtgtgttcaggaatcctcgccccctccctctctctctctctctctctctctctctctgtgtgtgtgtgtgtgtgtgtgtgtgttgtttgttcctgaaagcatcttcttaactacagcttttattttgtcaatatatttttcatgttaaattgttctgttagtgactccaagaaaaatgatgtgtgtgtgtattgaaacaactataaactattttagtatgagctattttacaaaatatctgtattcatccagctttatagtgaaccacccacacttgagtcactttcctaatacctgctttagcactttttttttttgcttttgcaatgatttctgtgtgtcttgtgacagtatttgatgacaaggaaggcatttgagtttttgttttgcatttattatttcagctgcttttaccaagtgttttcaagcttctgtggggccttttgtttcttgctattaagaaaattcaaaagaggcacataaacatgtgccattaagtttatacactatcagtcaggtacaggattgagatcatgtgattctaattattgctgagaaaattgaagacgctgtcttcatgctctggctgctaagatttaaatggtttgttaatttgaggtggaatttaactaccattgcctaagactttaaagtataatatgcacttaaagtgagagtcatcatcatgattgataggtaactgtatttcaaatcattactttaatcatttatgtcttgaggagacagtttattagttagatttttgttatttttactatgtggtaatggataaaagatgaagaattacaaagaagacatctaacagtctcccattttcttgttcccttgcgctcgcattattggtattatcctattatcttcaatctgttgtctttataggaatcacttagagttgattttctattttctgagggcttatttggttaaaaggagacaaaataatcagtaaatatacctaacattaactgtagtgtgttgtagtacactgactgcaaataaatctgcattgtgaatatttcactgctcatttaaactacttagggtaccattcaacctatgggtccaaagaagaatctagtgtatattctctgttaggtattagtaaatcttattttctttaatcttttgaatgactgccatttttcaaccctcatgggtcctttatgtaatctgtctactctagaaataatggttgatgattgtactcacaattagcaattattagacagtgaaaactctagttatgttttcttatattaaaatacatgattttgggtggaggcctctgacaggaccttgaaaaaagaaatagacaggaagttgtgcatgaaacttagtaatattcacttaatattatgtatgcctttgtgtttagcctcattctatattcagaagtactatcttttcactgtgtccacttgactttgttttgctaccagagctcttatatgttatgtggctatagtctatatagtttaatagagttacccaaatcttttgaaaacttgaggcagttgataactgccaggtcaactggccactaattaaatgacataaaaaaaatctgattttcattttaatttaagaagtaaatatttgttcttgttttgttcagaaaagctagaattatggaatagaaaataaagttttgggtatagggatgtatacttgagaggttgaaggattatgagttctaggctagcctgagctacacaacaaaaccctgtgtcaataaaacagaagacaaccaaacttaaacttacctaccacccacacaaccaggaaaatcatttgtttaaataacattataaaattccactaattttgaaatgcaaaacatcaaaaataattaaatttattattgacacttgcatattttaggtactagagtgacattaattaattttccataaaggtctatatctctctagcctaagatttggaggcagagaaaagagaaaaccagagagggatgagaaagaaagaaagattaaatgaagtaatatttagctggtacaacttttaacctcatcttactctatttttatatagttccttctgtatctctgtagtcgttcagtgtttggggttatatatgtaggtcagtaatatagcattgctgtatatgtatgaggttctgagttcaagtcccagcaccaaaataaataaatgaaataaaagcaaaacaacaagaacaaacaatatttgaggtagtaaaggaatgtgtctagagagagacaggaaagagatgctgtggcttggttgctttgcttctctaatcttcagcttgaatcccaatatttgtctctaggtttttattatttgtgttgcaatttacaaatatggctttgctgaaaactattctatgtggtcaggtatttaaatgtcaacatcatttgtagcactacattcctcatatattgttgatacattaaacagacatgtaatatgcttaaaacttgctttctcttttgactatcaaaagaactgtgttcacaagtagtttcgtattcaattatgttgtctagagttaatattgagttacaagcattgctctatttagttttattattatattttaaagctagagttaatgatttggaagtatcagctgcacaattagtagtattttttatttctagaagaattaaatgagtcattatagactcttttgttcatatgaacgttacccattcctaaccaatgtaggcagccatttcataagtgaaaaatgctaataattctgaggcaatttcaatatttaaagaaaaggcccaaatatcaccccacctcaaaaaattttagtaagtgcttactgtattccagggaccaggatcttacctgggattgcagagctaagaaagttcctgccttcagttaccttagagttttatggtgatagttctctgacaaattgttaattataaataaaattagtatggaagaacaggatgaaggtttccattttgaaatggggcaatccagaaaatcttatggaaagcttagcggatgagtgtagtttaaagtataataactggccagcaagacacaaggaggtaggccctattgcaaaggatatgacagactctgaagaccctctatggaagacctcaccctccctggggagcagaaaaggtacgggatagatagggtgttactgaagggggcaggggaggaggggagggagagggacctgggattgacatgtaaaacaatcttgtttctaattcaaataaaaaaatggaaaaaaaaagaactggccagatgtagatttagctggaggcagcagctcacactgtgagaggtggcaaagggaacaacagtgggaagtttgagtcagcatagtatgtggaacaatcacggccgaccttgtattgaagcatagagggttaagccagaagaagttcccaaaatgacggtgaggaattgatagccgtagtggtagataccattctgtgggcactggttaatgtacaccaggcttgatatatatgatcatactcaattttgacaacattctctgaggtatataatcttacattcctcttactgccttgcctgttattctgacaacaccatttttgatggcctgaccactgcagtgcgtgccactaaaaatcaaatggaggtaccaatgtggagctatcactggaaggagagaggatactactactcttttaggatatgtggggatgtttacacatccagaaaattctgacagttgcacagttgattgtacttgggacatgtagattcgttgtaactacttttatttcagacagaaacgtcatcagaatgtttgaggcagtaaaaactccaacacttgtggagagaacataggaattttgatgaaaaccagagcaatatgaggctatggaatgatgtgcttagccaataaccctgtaaaattcaaggtcgaatgaatagatgtatattatttcaaggggaagaagaagcctcagaatatttgagagtggtagcgatagattctaagtgatgtcacatgaacataaattgaaactggtatatgtatattttagcccgagaaaatgcagacgtccaaaaacatttgcatggttcttaaattaattcccttcaaatcctgctaccatcctctttagtttgacaattaaagtattcacttgaaatgcttcagtatctcacatttttgaaaggaaaaatacatgatgtagatgtttaaaagtagactaagtattaagagatattagcttgctcttcaatcaggagtgttgcaacaatagactccagatggcattataggaattgcttgcagagccacatagtgaaatatagtctgattaaggagctgttgccactccagaaccaattggtctgtctaagtaaaaaatttgtggctgctgccatccgctccctatctacgtcatctctgttgccacccacaccagcaagatggatggcctgttcctggcctatttcttcacctagtttataaatgcatttcattggtgaagactaagccacatgtgtatattgaaattacatataaggatagcagacaaactccgtttttatggagtcatttttaaactgaaattgacaatgtgaggatgcatgaaaacgtagaaggcatgtctaaaccgtgttgggtagccaaaaatgacagatgaccactggaatctttcaactggtctcctggctgttagtcagatttttctcattcttcataactcaagtctaggctaaaatctttgctgaacttatttaccatctgtcttatattttcaaggaatctcatacatgtctccattataattccttgtacctattagatcatgaattagttatgtttctttagtcaacaacatatataacatttctaaggtccagccattgcttcacaaataatagcatttaatttgagtataaaaagttactcaacttttcagtgttaacagtctagcacagttccttatgtatactatatgttgaataaataagtgattctaattttaaaagaagacataaaaagtcaatgtcttttgactttaatagtttttaaaattttcctgaatgtattttgtatctatttctataaggaaaacattagcaaaccttaaactgcacacaaatgggtaagttatgagtgagttttctgacagctacaatagaaggaggggaatattttataagagtaaatggtttgtaggaacaggtgtagagataagaagtggcagagggggagtaacatgatcaaagtatgtttcatacatgtgtgaagcttcataatgaagcatgtatatggttgataatttaaaacagagtttttcctgtttctcatacatacatacatacatacatacatacatacatacatacatgaatgcagagagagagagagagagagagagagagagagagagagagatttcctcttttttctgtttcatatacaacaactttctgagaatttttctttggcgatgtatctcctgataaatttgtctatcacatatgttttcttgggtaacagtggtccttgggaaacatggaccaaagagtagtgcacgagtgtgtgtgtgtgtgtgtgtgtgtgtgtgtgtgtgtgtgtatttgctgtagagataagtgaatggtttttctaggactgtataatgtacatctatgttatgaaccaccaaagtattccatagcatagtttaaaatttttctttagttttcttcttctcacagttcagctagggagaagtataaatcatgaatacatgtgaaatacacacaacattatggtatctcaagtagtaaataataacccaaaatatgtctgttgttaaatattaattgcattaatcacttttgtgatgcttacacaacaatccatccattctcacagtagatgttctttctaataggaggatatgaacctgaatgaagaaaagaaggctcctttacgaaacaaggattttaccaccaagcgtgagatggttgtccagtatatttctgctactgccaaatctgtaagtagggacaattcccaggcaccaacagaatgagcttagctgtttgcttaaaggttaacaaacctcaactctttaaatttttgcctcagtgaattcatattgccaattaaggaaacgacatgtgtacacttttacatattttgcacatatatctcagtactgaactgtttattagacatgagagatccatgattataagcaagagaccagtatggaagtctcttgattgaattcagtgaatttgagggcagaggctttatgcagtcactaaaaatttccagtgttttgctggtattctacctactaaacagattgctacatgaaattttcagatttgagggagaaaacacaaacagcccagccacctttaatcaagtttacattgaagcatgtacttttaaacaatgtttttcatattttgctttgttgttttgagtgcaaactgtgtaagctgcctcataacctgtgtggtaaagctcaccttaatataaaggaaagcaaacaccaggaactttaatcaaatctgtatgaatttcaaaacctaaacgtttgtttcattgaaagaatttattgtcaacaagaaaaacttactcctttaatagaattgtttattttttcttgttacacttctaaagctctttgaaaagcaaccttcagatttgattttttgtaggaaattatatattattgatatgacaaaatatatctcttgtattcttgtaatgagctttatatgtctagatttcaaaaaatcactatgtgcatgtgtgtatatacatgcattcatatatatacatacaaaatttatatgtacgtatatgaatatattacatatctgtatttgtacacatgcatttaggacaaagtattttctgtttaaaacattatccactgaagaaaatgtccttaactgtaaaagtaaattccagcatcatttggtaatgtcattcatactttttagtatactaattccagtagcaactgaagaattttgtaattatattgcttcaatattgtactttaggcaagctaaatctgaatgctgaactatttaaacataatgcattgcagctctgccagagcagagcaacagcatgttttttaatttggttctggtatccaagggcagaaatatgtttcaagtgataagtgaaatttgccatgagcattatatatatatatatatatatatatatatataatattatatgagtataaagtagaaataatatatgactaatgatattgtgttttaatgatggaatttgttagcatctctggctcatttgtgggtgttgtttgggtaagtgggattatctataatgaagattatatgacattctcatgccttgtcctttggataattacacgttatctatgcacagcatttttaatttatgttcatatggtattctctttaacccaccaaataaatgtatccttgtaattcttatgctcattttcatattgaaatgaaaaccaattggctgaagctcttgcttagcaggaagtgcaccagcctaacctattaaggctctgaattccatctagcacagagacagattgggaggaggagatgcagaaaggtgggggaagggaagaggctagacaggagcttattttaactccttaattcaaatgatagatatggagtgtttctaacaagacatgaaattttccatttgaagtagccacaaaattagtactacttactgactggatggcccttatttctgtcatccagtgtgcttgttagctcttcttctttcacaggaattccaagattatagttgttgctattatttttcatgggccaaatatttcgatggaagagagcctgttgacaagtagtgttttgaagctttctcaccttggagagacattaattagtactgttttctgtcattaaaactatgaaaattgtttgtgtaatttccctttaaagataagaggaatgtcattcgatgaagaacaacattcaataggaaacagtgctttcacctgttcatcatcatgacagccaattttgcaccaattatcactgaatgtgtggctgttgcttgtgtggagcttaggttcctgcccttctgtctggctttcataaggtgttaaatatgctttgcctgtcttgtacattttttactcttttccattgtattcgtatattcattaaagatgtttcctcatttaatgcagatgtgatgatgcctatcatgtgataaaaagtctttgtaggtaatcaaagatctcatctgagagtagaaccagtgtcaaagtgcaaaaaacgttcaatagtcacaagtaagatacaggaggcctatagttgaattttaatgtaaaattgttttcccctttaatgaactgcattgttcttttatgtggaatttaaataatgataaagtgagctcattgaggaaagggcattaaaagatgatgaagcagcacacagatatgtgtcagaacctgtttctaaaacaaacaagtctggtgctgcatcattaatttttgctaaaattagtattggataagaggatattaaggaaactacaagttaatgttgtaaaactattgtttggtcatcccttcacacttattgtaaagttctataatagacacttgtgtatgctaaagtaatggtagattgaatatcccagtgatgagtgaactttaaataggtatgtgaagaacatagtgtgcttttattgctctgggagccaaatgcttgtattgtaggaggtaccgttctaggcttgacctaagagaattagccgatatgaattattttgttacaaataacaaagtagattgtatagtttcaaagtgccattgcagaactggaaaaaaagctgctggtattgttaaagctgccctactgattcataacccagaatgaggcacattatgctgctgatttagagaagatcttgcatactcctaacagagtatgtagacattcattaggaaatgttatccaccagagacctaatgttagtgcatcacacaccattatccttacgacaatatgaaaaaagcagtttatttctaattttaattataccttctgaaatttagattttaggacatgtcagattacacttttgacaatgtgtgagacattcagaggtgtaattattccccccaaaccctcaatagtacataatccaacatcattagatcagttgtgtctcaaatttgtagatttaaccaataaaacaagtagatgaaagctacggtgcacatgacaatatgtatgcacttattgtggctgtgttgttgccattttcagatactttttcctcaggtccttttcatacatgggatggataaggagaaacagttgagcccagataggaccaaacatttttctccttggttctcttaactaatcaatctaatatatttctctgtgtgctttagctaaatgaaatcattttgcaatctgatcaaatcattaaaacagaccttgaatgggcaacattttagttgtttcactgactacgaacctgcattaattgttaacacaggctctcattctttccttttggtctcacgtctgtgctaaggaaacaagggacaaatataaactctgtcttctttggtgggaggaaataatttaggtcaatagcatatctttcatttcagaggactgttagtcacaccaaagaagcttctattcatctaaattatcactgcttgtaaatagcgtgttatatgaatttttaaggaacttgcttcttcatttggaggctcggggattcctctgaaatcgtttacagccaccattatctttttgtatcttgtagtattttagtcagctgaggatacttacttggctttcaattaaatttgatgtttgttttaaagcactagctgaaaaatacaataggtattgataataactgttatcacatgaatcatgaattagctctctttgatacaatgcttaatattcaagtgtgagaatctgataacagtgattggacttatattttgatattggcataagaatatgtttatgttgagagttccctcttgttttcttaagcacagtcctgcctctcagaaattgcttcgtctcttgaaatttctgatctgtttcctccatattaatatgtgcatttttatggataaaatacattgttttcacatcatatagagaaccctgacttcatacttggaacagtatgatgacccagaaaaaaataataacaaatgtgtcttatcatttaaaagtataagtcaaaatgatattgtacattttaaatttgtaacaatataaaacattcagttttcaagtcaagttcatttcagaacttgatgcatgactttaaatgaaacatttgtcatttaaaataacttaccctgaccttaacactatttttaccatagctaggaaagaaaacgagagcaaaatttggaaaaagttcctactggtaatttcttttagtggctgtgagtagggaaattatctgagtgtatattggagttttattttatatttagattgtaatgcatggaaaacctattagagtgcagactttaaagaattctacaacatcatgataatttttctgtatgtgtaaactctatatttaaaatggcacacattaatattgctatcttgttttaagtttgttactagagtagactagtgactaatttactaaacaccttctttcaaagcttctgattactaatattattgctgtttgttttttttcacactgtaaccattctccgttgaccactgcatacagatagttggaagtaaagttacggtaagtacaaaagatatgttttacctttagtactaaatttgtgtttcagaaatttgtgattttttgcatgcagtaattaatgtttagtttttgtttgatgtatatttttccaaagtgttaaggcaaatattgacatctagtgattacaatttaggttggttatgtactttcttacagttttgtaatatattttagaactagaatatgccttggttttcttggagttttttcccccttggagaatcatgtctgtcattttagacaacatgggtgaaattgtgtggtgtatgtcagtttttcgggatcagagtgtttgtgtatgtgtgctggcattcctaaaatattggtcttctgtttacacaaattcttattttgatgtctgtctttggtttgggcatcattgatgtgtgtgtgtgtgtgtgtgtgtgtgtgtgtgtgtgtgtgnnnnnnnnnnnnnnnnnnnnnnnnnnnnnnnnntgtctgtgcacgtgtgttcatatcaactgatgctattcagttaggagtcctgaagatctggctttgtaggatgatatatattgactctgccatttggtgagtaatttttttccctgaacttcagatattaagtagataagttgaaatttcagcttatgttttaaggttcttgttggtgctacaatttaaagattgtatatttatggtattgtagttgtaatataacaagctggacattcctgggattgtatttcagagatgtttataatgactttgtctccttgagtatatgtcatttatttggagaatatagcatatgaagcatctttaaaaatcacagagaaatgatgaatttagtatagtcaatgtgtttactgtacctgtaaaagttccttacttattccctcctttcctcttcctccatgggagatgttatatgtggttaccaggaacatgttactatcctctttaaaatcttcaaatggctctcagtttccgggcgttggtggcacacgcctttaatcccagcactcgggaggcaaaggcaggcggatctctgtgagttcgaggccagcctggcctccagagcgagtgccaggatcggctccaaagccacagagaaaccctgtcttaaaaaaccaaaaaagactctgtttccctttataatctcatctctgattcattaaaatattgtatttacttgtgtgtgtacatgtatatatttcatggcatatgtatggacgtcagaggacaactccctcaagtcacttttctcattctgccatggggattttgctcaggttgccaggccactgagctatctctctgatcttaggcttccttttaaaaatgtcatctttagctgtgtccctgtgtttatcctgacaggtacccttgacgcttcctaaggatatttttttttcttgaatccttctaaatcaagcaagaaaagagaatactcttttcttctttggtggcccagcaagtacttctaagtatccatcttgattaactttcatgttgcagaaagaagctctcccatgtcagtctttccattccctgttgccctactaccatatttttaacattttagaataaagctcttccttgtctccttttgcaaatcaacacagctttttctttcaagaaactgagtctaaaggggaaaaagatagatgacaacagacaagtatatttaacagatagaggtccccaagaggctgtattgttatagcagatggagagactagcagctgtgcatggatcccagagggtgttcaaaggtgatgctttgagattaagttctatggatagatctagagtatgtcttctttcatggccattttttgcccatttgaactgtcaacttctgttgccaagaagtaaactatagtaatcccttctacaggaaatgaggaaggtttaatttaaagttgaaacaggaggtatgcattatggagatttgttttgtcctattttactttatttaatattttgcaactaaagagagagatgaaccaacaatatataaaatcacccgagttaaaagacagcttcaaagggcttatgtgtcataggctcattaatctccaaaaggtgggaggagtatatttgctggtaaaataggcaggtagaaatttcatagaggtgctatagacagtagaattctcatataacctatttaagtattgtgattacttagagattttaacattagtttaaaaatgagtgttggaaaagctggaatgaaattggaaaaatggaatatacaatgaagtaggtctgcatggccttttctcttttgtttctttaacactgattgcgagctgaaataatagcatttgaggccccgctgctgtttttttttaccattgctgttgcttttcattttttatatttataaagtttacttaaaaaacaaacctgaagctgcctattattgggatataactacaacctcatcctcaggtcatactgattctggctgtatgaatatcttgcccatattcactccacatcttttgcataaagcctgacttaattctgactccccagaccacctcccatttccactggatgccttactggaattcctgtagctctttcttttacacatgttgttcctttctatttgttgatttatatgactttacatattccccaagggctttttaaaaatgacattcctattttactttatagcaatttacatatttgaacagtaggtgctttcattgtttgggtttgtctttctgcgtccacaggacagattctatgttttatagaagtcatacatttataagaaaatgggtccagtttcagactctgttggtgcataaggcctgtatgatcttgagtaatttacagatcatatatgaacttcagacttcccattttgaaatgaaaatactaagttcaggataggtttcagtggactatttgtatttaatatactcaaactataatacttcagtcatatgtccagtttatcctttcattaattatgattgttatgtaaacatgttttgaaagtataaaacatagcaataactttttaaactaaaattaagatcatgaagtatttttttctaagcatacaagatatatgctgtttgtaggtttaaaggtatgggtgcaattatttcttggtcaagaatgatgggaaggctaggcagtggtgacacacaccttttatcccagcactcagaagacagaagcaggtggatctctgacagtttgaggctgccctggtctccagtgctagtttgaggacagccaggtattcacaacatagtgagaccctgtctcggaaaaaaatggtgggaaggatttttctgaaaattcaaaaaaaggctttatctctttattggaagctgtatgttatttggtgtgtattattgctaggctttgagaaaaatgcaaaacaacaccagcagcaacaacaaaaacaatagaaaccctcctatgtggtctcaagttaatactgacacattaattttaaagtcactaaaatagttgaagattttctatagattctgtctatgatgggaaaatgataaaatgtcttccattacctctctaaaagttgcagagaatttggggtcaaatagaggtagaactgggtagaactgaatgatgaatttgggggattctagttctaataaatgtggtagaactttgtgttttggtagaatatgttttattgtttaatcacacctcaaataaaacagatttagataattgacttgatttcctgcaagccaggaatcctttatccacacacataaaagtaagcattcttctaaaaaccacatgatcttctcactagatgctgaaaaatcctataacaaaatccaacaccccttcatgataaagatcttggagagaacaggaataacaggaacatatctaaacatgataaaagcaatatacaccaaaccagaagccaacatcaactgaatggagagaaactcaaagtgattcctctagaatcaggaacaagacaaggctgtccactctctccatatctcttcaatattgtacttgaagttctagtttgagcaatcagacaacaaaaggagatcaaaggtatacaaattggaaaggaagaagtcaaactttcagtatttgcagatgatatgctagtctacatatgtgacccaaaaaactctgccagggaactcctacagctgataaacaccttcagcaaagtagctggatacaaaattacctcaaaaaaatcagtagacatactttatacagatgataaatgcaatgagaaagaaatcagagaaacatcacccttcacaatatccacaaacaatataaaatatcttggggtaatgctaaccaaaaaagtaaaagacctgtgcagtaagaactttgagtctttaaagaaagaaattaaagaagataccagaaaatggaaagatctcccatgctcttggataggtagaatcaacatagtaaaaatggcaatcttgccaaaagtaatgtacagagtgaatgcaatccccatcaaaatcccaacacagttcttcacagactttgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttgacaaagatgctaaatctatacaatggaagaaagatagcatcttcaacaaatggtgctggcacaacttgattcagacatggagaagattgcagatagatccatacctgtcaccaaacacaaaactgaagtgcaaatggatcaaagatctcaacataaatccggccacactgaatcttctagaagagaaagtgggagatacccttgatcgaattggcacaggagactgctttctgaacattacaccagtagcagacattgaaatctgcaattaataaatggaacctcctgaaactgagaagcttctgtaaggcaaaggacatggtcagtaagacaaaacaacagtccagagaatgggaaaacagcctctctaactgacagggggctgatttccaaaatatacattgaactcaagaaggtagccaccaaaacacaaaacacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggagagaagaggaggaaatggagtagcagaaatattgagttgggggaagaatagaggagagcaggatgagggataccacattagagggagccattttaggtccaaggagagatctggcactagggagannnnnnnnnnnnnnnnnnnnnnnnnnnnnnnnnnnnnntaaggggagccattataggtccaaggagagatctgacactagggagatttccagagacctacaaggatgatacaaattgacaatccaggcaatggtagagaggataacctaaacgcctttcccctaaaatgagattgatgactactttttcatgccatcctagagacctcatccagtggctgatggaagcagaggtagacatccacagatatacactgtggacaatccaggcaatggtagagaggataacctaaacgcctttcccctaaaatgagattgatgactactttttatgccatcctagagcccttatccagtggctgatggaagcagaggcagacatccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcattctaggaggcccctggtggtggattagtatttttccctgatgtaagaagggactttgagagcccatcccatgtgaagggatgctccctcggcctagacacatggggaagggcctaggcccagcccaggatgatgtggtggactttgtagagcccccgttgagggccctcccctgcctggggagtggagggtggatggggtggnnnnnnnnnnnnnnnnnnnnnnnnnnnnnnnnnnnnnnnnnnnnnnnnnnnnnnnnnnnnnnnataactggatgctggcatgtagaagactacagatagatccatgtctgtccccatgcacaaaacttaagtccaattggatcaaggacctcaacataaatccagccacactgaacttattagaacagaaagtaggaaacaccattgaacgaattggtgcaggagactgcttcctgaatataacaccagtagcacagacactgagatcaacaattaataaatggaacctcctgaaactgagaagcttctgcaaggcaaaggacacagtcaacaagacaaaatgacagcccacagattgggaaaagatgttcagcatccccacatctgacacaggacacagggctgggagcccatcccacatggagttatactccctgagcctagacacaagtgggtgggtctaggccctattccaaaggatatgacagattttgaagaccccctacggaaggcctcaccctccctggggagcagaaaggtatgggatagttaatgtataagtttgggggtggcaggggagtaggggagggagagggacatggaattaacatgtaaaataatctttctaattaaaataaaagtcaaataataaaaaaacacataaaattataactataatgattagaccttatagggttaaacatagataactttagtataataaatagatcaatgactagggcagcaacagggactttagtagtgtttgttttacctatggaaacagcagaatttaaatagctgacttatggccagacatggtggtgaaggcgctcaatttcacaacatataaggcagaggcaggtgagtgtcttgagttcagggccatcctggtctacatatctagctccaggccagccagagctacacagtaagatcctctatcagaagaaaaaatgcctaatttagcatgcattcattttctctgacagttagatacagggtttcatgtacccaaggctggccttttacttctcctcttcctgtggtgatctctcacacactgccattacaagcataccctgccacacccaatgacttctttttagaacccagagttattaggtacctgtcatatatcaggcaacgttcttggtaatattgccagagctcctgaccataatgcctgactttgcattctaatacatgtatgtattcagacaaaaggccacaaaatacatgaaagtggaaaaataattttgtttccccttttataccaatattggtgagagagagccagtttcattctgtctccaccctttccttagcagtgttatgccttagagggaaagatgaaacaaaagcctggaaatgcccatatagacctaggccttcagctcccatttagggaactggcaggtcagtctttctggtgaatggaccttttccactctaccttgacaggacctgtagaaagctggagctgaggaccacaatttacatacacaggtcgtaatttctaggcctccttgtagtgttagcatgataaactatacaggttgtcctcacagcagtaacattttagttgggaaaacagacagtaagacacatatcaaatattatgacaggttttggcaagtgctatgggaggaaaaatgtaaaaagagagcaagaggaggaagcacagtgatcagggatatactgttttaaacaggcgagctatgtgagcaagtgagaactcagtgaaaatggagacagctatgccgatatctagggaagagctttgaagccagagacaatgtcaagtgcaaagccttgaggcaagatggggcatggaatgtttgagggatagaaatgaggacacagtgggtaggtagcatgggatgggcaaaggacaggaaggggtttttaataaccaatgctaagagctagttacaatggctgcacatacacttaagtatagctagaggtccctaaacttggaaaggtatgctgaggtcattttaggagaactgtatgaaagacttgccagttgagtagtcattgggcatccctgcgagtttgtgagacttggaatgacagaatcagaggtttctgctgtggaggactcacagtagtagatttggagaggttagagactgaggactgagagctcaagcaagtggtttctgcagggttgtcatgactctgaactgcaatgtagttagtaggaactaaatggagggtatagacgagagtgtaaggaagactggatgtgaactatatcagtctcagcaaatgaatataaagggcacaggagatgtgtgccttaataatgactgaaatttcaagcgtggctgattaaaatgacttgagcattcatacagaagtcaagagcaagaccaagtttggagtccaagatgatgagttcagttagacacgtaaatcaaggagaaatggctcagaccacaaaagcagaagtaaaatctggccatgcaaggacttctctttagttttacagcattaacagagtgatttttataatggggctcactgttgcagattgctgcttttgctatttaaaatatactttctgtaccttgctgatgagaagagatcagttatcatttgaatatatttcactagctcataaactgaagctctattgtctttactaagtcaggagtgacatgagtgcatttcagtgactcggtgggttagcatagagaaggcaacacgtatttcctagtctggtgtgttgtctttcaaataggcgatctcaaatggttaaaacctgacttttttttttccttttgtaatctttctaagtaatctcagtccaaaggacaagctcatcgtagtgaaggctcagtgtgttacttttgcccctaatcaggttatgagaattgtctccattaattgagtgatttacagggttttgttccaaaagagagcctggtaggtctctaggattcaggatggtaaagaaagtaatgcagaagtagccataagaactcaaggctaagcctgcaccacagtttgagacactgtgaagacagcaagagagagacattgagatggagactgagtgattgatttatggccagtttctaagtaagtttacaatgttctttctatgcatctggcaataaaccctctattattagtagcattcataaagtattgctaagcatggcagcatgcttttgtgagctgtcaagctgttagtctatttttacatttaatatttatttatttagtttattaacagtatagtacctcaatgatttcttcatgttgacaatatacccgagtcacgccaattttctgaacatatcctttgaggaaagattaaatcttattttcctattttttcctttctataattaggtagtccagaagggggagacaaaacattgattattggagtttgaagtagttacttcatgatgataaaacattgctttctcatattccaagttgattgtgtttttctaacggatttagacattgtagaatagttgctactgtaaaagatttagttttgatggtggtaacaatcttattaaaaatctgcattcgatcagaataaaaataatcaatgtcattatttttaactataaagtagaaaaactcatttgttagtaagatgaaaagaagacccgagactattgagtggtggcatataataagtgatcttttaaagaactgcacaaacactattaaagcactcattttagtcttcactaatttcacattcattactgcaatgactagctacttgctcagtttctaatgctttaacagtgtgcaagcttgtgtattagacttgttttgggtaggatgcagaggatctgggaacctggctcagtggtaaagcatttgcccagctgatttatgcaacaaaacaacaagacccaaaatacatcaagacaaggatatctcatgtatttttaaagattattcattgcttaaatctgttggaaccatttctagtctgttcatactgtgcaggagatgctgcatcttatggaatgaaatacctctttgcacctgttgttttgtgggccccaatgattgagcaagaatgatctttgtgctttggagtagtcatttgcaaattggcaacattgattcatgtaaacagatgatgttatgcaacttcagtgggaggaaaaagtgcaaaattactgttgcattagggaccaaaaatacacgctggaagcaattccatttctatcattggtcaataagtttttgaagccattttttctatgctgaaagaaataaaacattgtccttttgcgttttatataataaatgttcacctatcttatgtactcctgccttttataattaatttcaattaaatactagctttgtttaattaacatttaattaaaatgcttataaactctcagaggtcaaggaccatgtcttagtataccttagacattttcaaataccctagcctgtaacagcaataaaataattagtaacttctgttcattcactgcattcttataactcaagtgaagttgactgcatatgaactgaaatcagaagacttctagttattttataatgcttctcaaaaacagtgctcatgctttgcagatgaagttcagcatcataaaaatctctttccccccttagaataaaaagaaaaaatgaaatatctttcttcttgataaccttttctgctacactgaagaaagttgttcattattacacatgaactctcctagggcacttgtaggcttaaggggcctttcagcttcttctaattcaagttatcctgttagagctgtcattttttttttactgttgtttctttttctttctttttttttggtgggagtacagtctatagattggggcttcagaactgttaagtatttctttgtaacccaccctgtctcgatgttctttttcttctttcgctcagagtgtagatgtgtctatgtaagtgttctccttcttcagtttagatgtgggtgaagaatattgggaagggtccaccttccacgtcattcttgtcccattatccaacatttttctccgattgtgtttgctcacagcatgttgtacacagtgaatcatacttacaggaaaccttccatacaaaatgaatgcttaatgcagaaattataacagttgaacaaagggatgcttcattattttatttctgttacagccaacagtatttaaattatgtctaatgcatgctaatacatggtccttgtcttttgagagttcattagcattttatttaaatattgctaattaaacaaagttgatgtttaactggaaaaattatagctcttggactttgaagacctgttgttgtcagggatttactttttctatgccacagtgacttgggctaaaagactaatttttctttagtccacatctccatgtgtattttgctatactgatggagttatgaaacacttgtaaactgtcaaatatgctacatattaagccattacagtaataaccagttaaagagataattctgatggtagttcctaatacacatttcaaaagaaatgtgttgaactacaagtgctggctgataatgcatttatgtattcatttcattacttagtgtcttctttagaagccaattatgcttttatcctttgtaaaatctcacatttttgacattgctctttggctaaagattatgtttactgtcgcttctttatgaaaaggcataagcaactatggatgtcatcccctaatctggcatctaaatatgaaaaatacccatctttaaactgtgcagccatggcatcgttatttagtctgaactccttgcttataatactccataaattaggggtttaataactttctaaaactgatgtcatagaaaatgagaaatgacaaagtttctgacagagtaatttcagatttctggtagtagttaagaattttccctcttttaaaaaggaacataagtataaaagccccaaattcttttaaatacatgatttaaaagaagccttcaaaattttacctttcttctttgtaagggcaatgtaattgcgatgagaagatggggacgaggaagagagggaaaatgagcctagggaatgaaaaaatacatactggcatatattcacaaaagtgtgaaaatgaaacatgctactttgtgtattaatttaaaagactgccttaaaaaaacagtgcattatctgaaagctagtggagttgaaaaagggaaatgtgcttgttagcttttttgtcaacctagtcatatctgggaagaaggaatggtaattgagaaaattccccttacggacaagcctgtaggacattttcttgattcctaattgatgtccaagggctctatgcactgtgggtagtgccatccctggactggtagtcctgggttctttaagaatgcaggctgatcaagccacaaggagcaagccagtaagccacattcctccatggcctctgtatgggctcctgtctccaggttccttcctgccttgatgataaactataacctgtaagaggagatgatccctttcttcctgaaattacttttggttctggtgtttatcataacaacatttagcaaactggaataggaattaaaaatgacccacaatcctataccccttatatgaagtgttattatattttggtaaatttatttatacacagtcatttctttgctgcattattatgttattaaaattgatactaatttttagtcaatacagttttctttcagaaatgcatatttactttataatgatataaactgataaaatacttttggtagattaaatatttgataataaagtagtattgtaataaacccaggcacccttgaatcccttaattacagttactgaaaactcaatatccagaaccaattttctccttgtttggtgatggcgtgattttatctttggaaaagttgagtatttgaatagctatggtccatctttgtttttaagtgtatttttctgtatagtttgagaaacctgatgaaaaattgccatgcttcctagtctattgttgaattaaaatgaaacacattgccatcaagatgtaaattttcatatttacaaggcacaagtaatttgaagacaaatctagaggtatggggtcagtaagtaatagcagaaatgcatcaaagagtttgacaaaatttggcaagccctgcttttccttgtttgtggggaaggtactgctgaattactattccaaatgaagcaaggttttcatttggaaaaattacttgtattaaacagatgactaggctgaaatagctgctaaaacaatttcatgcttttgtttttaatgtagtccaattataaaatgtcacatcaaattgtatgtgaatacacaaatgcataattctaattttatttttgagttatcacatttcaggaagttgattaaaatcacccaaaatattttctaagctttttgtgtataacaaattaatcacttttgaaatgagttaaaatgagattggaattttggcagataatgttttgattaaatgaattgattgataattctatagttacttgtttggtctgttttatgaatatgtaaggaactccctgccaacttttcttacttacttcagggcttccagatcactgcaatgctacaatgaatatagctcccactcagtctcttgttaaagcattatattatactacatttgctttttcagtcttttcctcctccttctttttccattttttggagtctttgttgctgatttgttatacttcaacctttcatgcttaaacatgtatcaccaaagagcaaggaacttctccaacatcagcagtgcatataatcaaatttaaggtattttcccccactgacatgatactgttattcaactatgcccatttttcaaatttccccaacggtcttagtagtcattataattatattcttacagtacagttaaagattaaactttattgtctgtatcttcctcatctccttcaatctagaacagtttggatgcattcgatatgtttttgttaagactttgaagaaaccaagtcagttactttgaaaaatgtttcccagccttgatttatctgtatcttcatgattaaatttagggcaaatatttttagtaaggattttacataggtgcttcttggccttagagcatcttatcatgagggatatgggtatttgctgccccatcataagtgctgagtaagtgtcctttatatttgaatttaataagtgataaataggatgttttgagatcatgtaagtaaactattacttagcaacattttgtatatttttcacacctgtggatggtattcttgctccaagtcatttattacttgctttgctacaaaatgattttctgatattgtctttatttttgcatttgttatatggcattcttctgtaaaataggattttattaacctccccttcctgtttgaattaaaaaaataatcattatgctctcatacattgcttatttaaattcactgccacaacttattgctagtctgtgaatgcctttcatgtttttactaaaaataacatataaataaattaaataagtaatgtatgcttcatttgtagtgtatattatctttaatccagcggccattctgatagtcacccacatgaaacattcgacaagtacacagcacaacttgaggtagcaaaagacccaacttgaaacattaattcattgtagttataaatggaacttacatgggttactgcaaaatccttttgaatattttaagtattaaattctactttttttccctttgagacagggtctctctatggagtcctagctgtccttgaattcattatggtgaccagaatggcttcaaaaatcacaaagatcctcttgcctttgccttctaggtgctgggattaaaggagtgtgtcttcatgcctggcaaaattctccttttaaaactgggactatattaagatttgtagttggtttgcaaaacaatgggtctcattatgacatttcatacacacatacatacaccccttgctcatctttgtcacctaatactgtccttccccatccattcatcactctcttgctggtctcttgtttcctccaaatagtttaccttatgttttcatggtgtgtgtgtgtgtgtgtgtgtgtgtgtgtgtgtgtgtgtgtgtgtgtgtattaactttttgtcaatatagattctgcatgagcgaaaatatgtaatattttgcttcttgccaccattactctcttgtttttcttccctttaggccttttacttttgtatcttattcatatgtattttatatttatacatcctttccatatatgagacaaagcagtcaatgtttgtgattgtgattctgggttattttgcttacagtgacgatctccagttaaaatttacttagaaaaatcttctttggacatgagaattctcactactgaatgagtaaagttttcagtcatcttcctgttcaaggttcactactgtctagacattaagaagagtttgtcattctgattatcaagcatgaatttacaaatatgcccaaatttatttttgaaatgtaatctgcagtgctgttttctggaatgtgggtaaacactacattctgttattcagaactttgcagtttcttcattctagacatttgcagccatgctcagtaaattatgtttacaaaagagagctctacttaaagtttagcccaaagttcagagcccttattctgtttactccaaactgatggaaaattacctccccagcactgccatttctttccttctaatagagagtgtcatcattacctgacccattcgactggttcattttaaaccctttcacttttctttttagggtgtctgtcttgggttctgtcctttagattatgctaatctgagtaattaggataaaatatacctgaagtttcattatgtaagagttacttgctctctcttaaggtaaattagttttcattcacattttctcttttccttcagatttatgttcaaactattttcctaaaaaaagtattaagaaaataaattacagaagcatagataagcatttttatgggtaaggtaaacacgagataattcccttatataatgaacaatcatcagtaagttattttttatgcagtactaggaattgaatccatggctttgtccattcagtagaagtactcaaccactgagctactttcctaatgtaagttattagttctttagtgtcctgtgtgtatgcagaatagctcaagtataaatattttattgagcaacagtcaagtggaaagagatgaaattaaaattaagatgtaatatactgtatttattgaaatagttttttcagtggtgtgtatgtgtgagtgtggtatatgaacacacgttgatgtgcatgtgtgtttgtgcacatggaggccagatgaggatactatgtatcctgttctgtcattctctgctttattaattgaacctagggctcccagtagtttcaaccggatctgtctccccgccccaacactcccagccctgagattacaagcatacatatcaatacacttaactttttacatgaatagttgagatttgaactcaggtcttgatgcttgcacagaaagtgctcttacctgctgagccatcttcccagcccatagacttatagtctaagaaacaaaattaatgttattgaaatgtattcaattcatcagtgatataaatgctcatacatattcccaatttcaattgtgtgactcttctatgacttgtctgtagttatccaatgatctataagccatatgacttcggtattttttgttagtcatttatttaaaaatatttatttagtactttctgaatgtgccaggtacttttatagatattgggagcatagtaggaaccaaaaaggttaaatggttcctcaagttgaaagtttacttggacttgtgatagactagaatgttcatgtgtatatttgctaggtaggtatcagttcctgtcctctcaggtagatgctagtgatggataggtatgattctctaggtttcaatatatctttataaatgtaacattttatttgaaaaatacagttagattaaattctcctaaagtattttctttcctgcaaaggatacagaattacatgacaaatgcacaaaatcagaccacagtgaaatcttagcaaaccaagggtaaattcggtgatattggtaaaacattcagaacagataccactatacagtgaagggtgtgtgaacgtatgtgtgtgaggatgtgacattgtagaggaaaaagccttgcatgtgtgagttgtgactaaaataggacaagatgggagaagaatgaggtgaagctcagtcacagtctagtaagaattaggaattacgtatttatatgttactggtttggtgataaagcttaggcatgagcaggctggtaactgatgccagaactctttcctttttggatagaaacaaaacaaaacaaaacaagtaactaagaagtattaagagtagaggttttcagtggtagcattggcatcaatagcatgtagatgtatcaaagccattagtagcagatgcaaattggagaaactgttatcagttttcttttttttaatttttttattagttcaagttagggaacaagcttgtttcacatgtaagtcccttctccgtctccctcccctcacccccatccttcctcccccaaccccagtctaccccccagcccatccaaccaacactccccaggcagggtagcgccctcaaaaggggctccccaaagtctaccacatcatcctgggccaggcctattcccatgtgtccagggcaagaatgtatcccttcaagtgggatgggctctcaaagtcccttcttacaccactgaaaaatactaatctactaccataggccccctagagtgcagacgcctccttattgacatccatgttcaggggtctggattagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaattaaattccagatttcagctcagtgtgtatctgtggatgtctgtctctgcttccatcagccactggatgaggtctctaggatggcataaagagaagtcatcaatctcattttaggggaagggcttttaggttatcctctccaccattgcctggattgtcagatcatgtcatccttgtaggtctctgcagatcatctccctagttccagatcttttcttgaacctatagtggctccctctaatatggtatctctcatcctgctctctctcctctattcttcccccaactcatatttctgctcgtccatttcctttcctctactactcttctcctgctgttattgtggcagctccctctcctctaccctcatgctcccaattagctcaggagttttctaattatctgtagaggtagtgactatgagcttgataattgaatggagatcttttatggtttgcatgtaaggtgtccatcacatgctcatgtgttggtatacttggtccccgcctcgaggctttgctttagaatgttatgcaacatttgggatgtggagtctttctagagaaaatgagctgctgagaagagtgaactagaacttctgggctgtagcttgggtcaccatctagcctgcggcctctgtcttctgatcatggagatgtgagcaagaagcttcatgctttcattaccatagacccatcactacagtcacctatcttttctgtatgtgccttctcaatccatgagccaaaatagatctttcccccttaagttgcctatgttatgtgttttgtcaaagcaacgagaaaatagactgaaacactgggacatcaacacacatgtttttgacatcttctgtttggtgcagcaataacagaatagtgaaggatgagtaattcataaagagcaaaaacttagttattttattgttctggaggataggaagtccaagattaaaatgctagcatcctatgtgaccgtctaactgcatcttctggagaggcagaatgaattgttctcataaacctgaaagaaaaagggcagagaggtgaaaggaggatgaatttgctgatttatcatagtatcatcccaccaaggagggcagaaccctcatggacctatcaccttccataggttacactgtcaatcatggtcagaggaacacctaaaattgaacataggttctagagtggcagatattcaaacatagcagtcttcacatgggaggcacaagccaaaccctagagtttcaggttctcttggtcaggaaagcagaaaggagagaattaaaaatagaagaatatatcagagagcacaaggatggactagaattgctgaagcaagtagaggagctgaagagaaaatccgtgaatgctacaagaaaacaaggagaggaagagtcaagtgatgacttttcacaagtttgaagtaatctctgtctttaaagacagttgaagaaaccaattgatctaagataccattgtacccacagggctctttttatagaaaggtactaaattctgttgccatcagtgaaacttcacagccttcagtagtataaaagaagttatttattgtggtagtgatcaagaatttggcagttgcaatgaattaaatagccccttgacaacttctgaagaagttgctgtctgcctttaagtgcttacctgattacctgggagtaatcaaagtgctgtgcagacaggggcctcaggtaattcccaccgggaattacttatatctatacaaataactatgattgtaagcagattttctgagagtaactggtggcagataggactgatgaacaatgacattgttatttgtatagttagttaacataagaaataaatacttgcagaaattacatctgagagggcccagagctgaaacatatctccctgggctgtgctttttgcctgatgacaccaatcctgttacttcactcacagttatgttttgttctgcatactaggattcttatagcattaggaagaattaaaaaggtaaaggaaaaacctggtgaattctgtatatattattgttagtaaattttcttttcatattgtccatgccaaattttggaaaatgtaataatcgaggctagaatgcaggcagtagcttctgtaataaaataattttttattatgtaccatgaggtaagccttattgcttcctttgatttatatgcaaatatttctttttcatatagtttatagtgctttcagctgctattttggtttttgtgctttagactgtctctattctttccatgattgccacaataaaataggcaagaagaaaaattatggatgcttcctgtctcattttgtgtatttgtttcagtggcagtaccaagcttttaggaaaccactgtagtcaatgtcatgaatttacagtaaacctgtggaatttacatatataaaacatagatgtcatgctggtgaattcaacttacaagaaatcttgcagtgaggctattagtttcaggtaatttaaatctcagtgggaaccaagaaatggattttgaactaatatatattttgaagccctcaaagataggagagtgtaatatttctgtgtaaagaagaaaacatctgtcattctttaaagtaaagaggtttaaatttaatgaagtgattaaaagtaatttcaagatttatttcccctcgataaatattgtttttttgttgattttaatggaaattgtttgaaaaattagccccgttttcagcataatgccaagtaaaaatgaagcatatctttcaaggtagatgtttttttcaataggggaaatgcaaaatgacatgtttttgagactatatacccatcctaatataatttattcagcaatcctgttcttgattacaacgatagtgtcttctttcaaagggtatttaatactagcttttgtatcaggtaaacttacatgtttctaaaatgtcctctctaattttataactcaaaggaaaatgcacaactgctttaaataacaggtaggaacactaaccttatatgtaattttcagactgtcttttgggtgttggcatctttggcactttgtcacacatttgttttctaacatttatggtatctattgtcaagatgataagtcgcatgctccccatctgtgttgtcagttcacttactttaagcttatcacacttctaatatggaattataatgattgatttactaccctatctcttttaggagactgtgtgatcattgagggttaggattgtgtttgtattctaaataaattctgccctgggttcgataccttcattgatagctgataaattctagtaaggcccccaccacatgcagtgaatgattctgctatgacttagggtttgaaagatgataatatcattgttattatccaaagagaatcatgtaaattgtgcaagtcaaattacatgtcagagaatgtggtgatgtctgttcctttttttaactttcaggaactgataattccaagaacatagtttgtcagtgtgcacagggttcttttaatactgtaaacccttccataaaagggccatatatttatttctatatcaccagcaaccaattgttgactttataaggaaaatagttgatgataattaaaattttgaatctacagtcatcatatatttcttgttggaatgctttcccaaaggattctcagggccagatcaaagtgtgaatcatttttcattatttatttttatatgtattcaacacaatcacatgtatgataggcataagtgttaccatggcagtctcctcattggaaggtgtgttaaaaggactcaccagagtgagggattagttttattaacagttacaaattcttagtgtagtctagtagacactgcttgattccaagggggacgagctctaggcaggtcctagaggaatccatgggtaggttggcttgctgtctgactcctgagagaggttacacagaaagctctcttccccagtagtgaaaatatagcaatatgtgagtgacctgtgtgaccgtcttgtccatggaaggccagtagaaagttagttccccaagttcttttagttgttgctgttttactttgttttcgtttttggctatttatataggtgctcagttgaacttttaggaaaaatacagattccccaatacaaagcagatcttcatcattaagcattttatttcatatcaatagacatagtgaccctcactttaatatttaggaaacctgggatatattctacatcctggtttccacactattaccaatagccaacattataagcaagccttacatacaggatagtcttatacttgttctgtgaacttttttggcagcatggctttgtgtgaatactatcgatggtaagagaattaaactgtagtgtgtgacattttttttaaaagtactttaaattacactcatatgcttaatctttagacagcatgatgaaggtctcaggttatttattagagatgtctctaatgctttggtggtttaagtacctgttcattgacttgcattattgctgaattccttagttaagctttatgagtacactaaacatacctgacttcctgctgccctggctagagctttacagcttgctaaaaatatagttgcttatactccatgtcctcttgcaaatatagtcagctagacatactcttgcttgatagtttttcttagagccatataatattatactgacttttattcagactttaaatttctttgttttggttggtgagttgggctattcatatggcagaagctaagaaaacaataaagcaaagaaaattagagagttccagaaagtcttggcatgttgttttaatttcacatattctgcaatgttaagatcttaatttcagccctgtgaatgtggcgtgtgtgtgtgtgtgtgtgtgtgtgtgtgtgtgtgtgtgtgtgcgtgcgtgtgtgcgtgcatgtgtgcatgctatctctcagggattcgcatacatagatcagaaattatggtcttaaaattgtacatctctatctatatctatatctgtatctatatttccatggtaattgatagaaaaccatctttgattactgctttgtgtagttttatgtgctaacatgtttgctgatttcaaggctttacatgaatgccttggggactacaattacggcagttccatatttggcgtagctccccccttttttaaatcaggaattctgttttcaaccatttgcaacattacttgccccattttctgacttaaatttgggacaagaagacacttaatatgtcttagtgacttgcggatgtcaactcaggctttcacccagttaatcttatgatttgagaagaaaaaaaaaagatgttattgacagtaagatgtgacagctaacagcaaaggaagaactataaaaactatagtagtctttagttattgtaccaagagacaagcagccccactgttttcaatggttttgaagggcgttactctattattacaaacactagaaactgatcttgctgaggtgccatcaagagaagattcattatgctctccagcagtatagcctgtgtctactaccttttataaaagtttccatcaagattgcttctctcccttcccttttagttattttatttaaaaacgctctcacatacagatcatacatttatggatcactgggtatggggaatgaaagaccccattgtacttggttctctttatgaaagctcatggaaaaataggtatccttgatttccttagtacttaatataataaaaagcatgcataggttcaactacagagtaatgatgccaagtgaacaagtaaggattgcagaaatatttggtgtaatttgggacacattttttcatgttctctcatgacttcacataaatatttatgaggtttattttcaaaggaaataacttgctacctgcaagattgtttaaaaaattattttcatgaggcatggacatcttaaaactctgtaggaaaatggattgtgcttcagtctagaaattagataaaaggtcccttaaccctggtgggaggggaagcatttttttttttttacatattcccagaatgtatgtttctggtgagctggcagtgttttttatgacacaagagaggaatgatgtctgtttcattatacaaaagcctgtccctatcccagcctgtctgccaggcaactctctggtaatgtttcctgacttttttttaaaactgtgttttagggattgtgataaatacaagtttttcatggatgatctcattctgtccttattgtaagtaatcttagaaggtgatcattattatcttcagttcaagaggttcatatttacaacagggaattataatgtccaaggtcaggtgtgcctgacagtgacctattaactctcaattgttctccctgtctaaacgcccctcctccccagcactttggtaagacagcaaggtaggcttactctacttactataggagacagttacttatggatgttagaatatgcaacaaatgcaagctgactcttttttctttttttggcttccagtatgggaaactccctgtcataaatgaattgcaaactattatcccttatttttaatcaccgagctataaaaatgaggtttttggtgatatttactagtagtctccatggttttcttgccacgttctcttctagcaatatttgattgcttatttgcagacagggaaccagcttccataatgatagaatgcactgttgttgtttttggtatctttggcaataaaggctgaaacagcaacctccaccccaatcacaccacgtccaaacaacagcaaagtacaaggctttatcttgactccatcatttgcaaaggggtcaggaattcctgcttctttgtttttaccatagtacacgtttttatagctcaaatatatctttctgtgtagacttggtaattaaatattttggttagcatccagttatgccaacaacatttgttgaagatgctttcttttttccattgtataattttagcttctttgtcaaaaatcaggtgttcgtgggtgtgtggattaatgtcagggtctctgattcgattccattggactagccaatattaagctgttttgattattgtagctctatagtagagcttgaagtcaggtgttttgatggccctgggtgttcctttattgtacaggactcttttggttatcctgggttttttggttttccatatgaatttgggtattgttctttcaagttctgtgaagaattgtgctgagattttgatggggattgcattgaatctgtagattgttcttggcaagattgccatttttactatgtagatcctacctatacaagagcatgggagttctttccatttcccagcaattctatcttaggcatatacctaaaggatgcacattcataccacaaggacatctgttcaactatgttcatagcagcattatttgtaatagagagaaactggaagcaaccttaactgaagaatggatacagaaaatgtggtacgtttacacaacggagtactattcagcagaaaaaaaatgacatcttgaaattcgtaagcagatggatggaactagaagaaaccatcctgagtgaggtaacccagacacagaaagacaaacatggtatgcattcactcataaatggatattagacagaacaacggataaccagccaacaatctataacttcagagaagctaggaaacaaggaggaccctaagagaggcatacacagatccccccagaaggggaaaggaacaagatctcctgagtaaatatattggttaaactattttaatgggaaaatgtaccagtgtttttatttttgtttgtttgtttgtgtttatgttcagctgatttacaaacagatttaagggtgtaatcatgtaaactgggactgcttgtaaaacataggtttggggctacttttactatcagattagattgaatattcttgttaatttgaatcttgtgatatgtatgaaagtgtacactgcagttagtttaacacttcagttgttataaaaggataatttcaatagtatgtaaatttaatgtaactttggagacttagacttagtttgttcatttcaatgttaatttatttaagttttagctattttaaaataggtttatgtgtgtgggcctggtaatgttttttattttggtttcattacattttgaaatgaaagtgactttaaattaggctccaaggaggtgttagttaaattattagtaatgagtttggttgctttgaaaaaagcatacttgtcaatgaataaacataatatactgaagcagaattcctttataatgtggctgttacagggccactaccttttatgcaaactagttttgttacacacagtgatagtttcagcagcaataggattttactgaagataataaaaattatttttttagcaattggattccagtttataccatatcctggcttcagttagaggaaaagacccttgcaagcctgtttttgaaatcttagaaacattgatgaatagaaagagtttgctctcccttgtattccattttcattttgcttcccattgtgtatgctatgatgggtgttcatttggcttcagtttttctttgtatttgtatttcttcacttaaacaacaatgcattaacatacgtgtcatactcattgtataataaaaacaagaaacgagactagaacttctcccatgtgttacctttcttacctctgtgatcaaattcctgaccaaaagcaattttagaaaacggtttattttggatcacatttttagaagtctcttctggtggcatgggttggcagtggaggcatgagaggctacttaatttcaccccaaatcacaaagcagaaagagatgaataccactgtcccccctttcccctttttattcagttcaagacaacagcccatgggattgtgctgcccacattgagtatatgtctccaaacctcagttacccccaaattcccttacagatactcagagatttcttaggtgatcctaaatataaccaaccaaattgtcaatcaaagctaactatcacaatctattaaacatcagttggattttactgttgtgggcatagcaatattaagttttgtgtttggatggtatttttcattgtcaatcactagcatattttcattgtctttcaatgacaagctatagaaaggtatataattttcaatagtccatagtattgcttagtgttaggaagttggctgatactccatcttcaaaaatataatatcaaaaccaaaccagtaccacaaccaccaccaccaccaccaccaccaccaaacctagaggtccatttgatgtgaatagagattctgttttagcttagtttaggggaaagaaaaatagagctgaaaagcatgagagttccaggagtttggttgcaggtactattgaaaagaagaaagaactctgccccctgtcccccagctcctctttccagtgtcctttttattaacactcttgtagaacttccaggaaggtgagtaattgtcctctgtttctttgggaaacgatcccatacattctcccaatctataataattgacctaactatttctttgcttttaggtttctgtagatttttttgtttctgtagttataactataaaaaatagcttttatttgtgtaaccctgaatacccactcaacttgaacttttacatttaaatagaaattctaagaccattgatcttcctgtttgatgacttctgatgactactgtacaatctccagtccttgctcatagcctttattttccatttttattagagaagtagaaattaactttgtaaaaggctacttgctgtatgtgcccgccctttaccctgaattcatttaatcctcccagatttttgtattcagactctttgagatgaaggaaatgaagattagatagatagacaaaggaacttacctaaaacgttgtggaaggaatcagaactcaaatcctgatctgatatcaagtccctggtttgaccctgcaaaaggatgcttgccattcttgtattcttttgtcacattcctctattcatggctaaagagtgagttattgatacaggaaagaaaatattacttgaagttaaagtcttgggaatttactttactctgctgtcaccccgtagccaacataatcatttcacatcttaatgaaaacatctatgtttcttgaatagaaacttcagtcttttctgttgctagccataccatatgttattttatcagcaagctaagttatgtcagaaagttggaaatttagagcagaaaaaatatccctgttctcaactcttaactaggggattataaatcaaggctaaggaaaaatctgcgggtgtgttattttgtgcttttatatatttttatgtgcaaaacatagcagtaaggatgctaaaattatgtggtagaaatggaatctcaattcttaaccaaatgtatagtctgctttagagaaaaaagatgtacatgaaagatatacacatgcataggcatatacacatatgcttgtgtgtgtgtgttttcttagtcatcttggactgtgggaagaaaatgcaatatgttgtctggttcaatgataaatatttttttgttctagagtatggagagtctagggtcatgatgctagcacatatggtttagtgaagaccttctcggtttatagactgtctacttttcagtgcctcatcacatagcaatgttaagaatttttgctatctcttattttcctaataagatgaactaaatttcatcaccggtactgtacccaaatgacccaatcaaaagataattgcttcccaaaggccctaccttctaataaatcacattcttgtttgggtttaacatacaaatttttggaagacacaaacattcaactgtaacaggtgctttcataacataaataatgtttgagtatattaaaaaaaacaatgtggtggactgtaaaatatttaagtgccatgcttttaaaaaccagagggaaactgttgatataagacagctggtgagttacaaacacagagaaacaatatgttgttcatatatctgtaatagtttattcagacttctgtaacaaaatggcacaaatgatgtaacatcattgacagaaatcgttgctcgtagttgtgataattagaaagtccagatcaaggcttcaacgaagtttttggttactgaggactcaaagatgtttcacagatgacccatttttgcttaatcctcatggtagaataggtaaagaagcccattttatgtctgttataaggatactattcccattaatgagagctccatcctcttgaaatagtccctttcttagtggtccccaactcttagaagttttaccttgagagttaggtttcatcacatgcactgtagcagcacctcaatgctgagtagacccagacacaaaggcttcagttaaggtatgttgaatggatgaattttaaaaaatcataaagtatcatttctgacttggctgtatcctcacaggtcaggtaaaaggaagagttgaccagtttaacttcattaagaaacattcaaatagcaaaatattttttgttcaatccatggcaaattcaaaataaggaaataattcttttttcctatgaaggtataagttgcatccattcaaattgaagctggtgtgaactgcagtggatgtaactacaccctgttataacacgtgtctttaatatgtgtatattagttaccctcatttatgggattctatttgctagtgttggccctaacaggcagcaaaacaatggaaactcgttttcttttggttctgaaggccagaagtagctgtaagggaaaatccattttattgtgtctggggagacaattcttgtctctgcttccaacttcacattgtcttatgcttttcctgttgagactctcctcttttgtatctttaacaggattagttctcatagcatttatggctcgctaacatagtgatagattgatgtaaagttgatctcattttgagatccataattacatttatggagaccctttggccaactaggatcacatctgtaggttctggacataagcaacttttttttgtagatgctattcaatctcccacatcagctgatgtttacagcagtagtacttgtgccgacctccatgttttctctttggtcttataggagtttctgctaggtagggggttgtttcattagcaccacaaaaaaacaaaaaatgatggaaattaaataaaagctttgttattttcatggatatgaagctagtttcatagtatggcctgaagtctgttttgtttaatgttgtagatattcctgaaaacattatgttaaggtctgtagtcagtttaagcattctgtatacatcctttagctatcatttggtaatgtacaagtcattcactttcttactgattttctatttgcctatcagttattgaatgaggcataatcaagtcagtgaccataattgcagatttacctgtttgtcctgtagtcttattggttattgcttctggtttttgaaaacagttactagtcttgtatatatgtaggattatatattacttactaaattaactcattttgccctcctgtacattaaaaagtacctaataaaagctcatctattggtttattatatatgcttcttaattatggctttcaaaggttacttttgggtggataatactgatctttaacttaaaacaagttagcttttgttttgttttgtttttcaagacagggtttctctgtgtaagagctctggctgtcctggaactcactttgtagatcagcctggccttgaattcacaggatctgcctgcctctgcctccagagtgctgggattagaggcatgcactaccactggcaggcataataggctagtgttaaatggtgttatttgcctttttttggagccttgcctgtctcctgacttttgtattgttgttatgtattctacttgtatacctgatggtacattgtattatttttagtcatttatgttttaagaaaaataaacactataaactaaacatggtagctgcatgcacataggctgtgcacatcccaggatagctatgaatgcagtcttgcataattgtagaaatgaaaacattatattccagtgccaaaagtttggatccttctgttatggtctgaatattattacatacttcacttttaaatgcaccctactataatgctttatccctttatgtgggctttcagtatgttcctgatacctactttctttagtgtttctcatagtacaaatatttatgcattggattttgcattgaatatttgtattcatctgtactgttttcaacttaacctttgaaagacatttcactagctacaaaattctaacatattttcttttcttttcagtgatatgttttccttagatccttgaaatatggtcctgtgttgatttctttctggctttcattgatatgaatgaaaagtcagaaatcatttttaggctccattctcttctatgtaacaagctatcatttctggatactactcttctattctcatcctacatgcttttaatatttttgttaaataactgtaactttatttatttacagtgctgggatcttactcaggtcttcaggaatgctagggcaacatgcccccaatagccataccttaagcctttcatttattattttttcaagacagggtttctctgtgtagctttgtagaccaggctggcttcaaactcacagacatctgcctgcctctgcctcctgagtactggcattaaagaagcctttcattttcttttatgaaaagtttaaatctgtttgggctcattggatttttaaatttctggattaatggatttttatcaaatctaaaaaagtatggttcattatttcatcaagtggttggcctatctatctatctatctatctatctatctatctatctatctatctatctatctatctatctatctatctcttcactttgctagaaaagttctctatagaagaacaatttatatttttatttctttattttattcattctattttgaaagtaatattctgctcatagttgaggctggcttcaaatttggtatactcttgcctcagcctcccatatcctggcaaggtaggttgttctcacatgctaagctagaaagctgatttgtagtgctcctcctttcattaaggttctcctaagtttttaaactttcctttccttttgtgtggtttggattgatactttccatgacccttattttcatttcactcttttcactactgtagtgtatcatctattaaacacatacattggaatttagttgcaggtggggcattatttccctgctctatgattccatatttttccagtttcattcctcttaatagtatatacattttctttaaatattaaagtcacaaataatagctttaaagttcttgcccatgactttacccttatctctgtctgcatttatttccactgactaacttcctgctcatttggaaatatattattttttctctagctgtgggatataggaatatggtattgttaactattagaagttgcatatttttctccctctcctttatttttttggtgttttgagacatgatatttctatgtagccctggctgttctggaactcactctagtccaggctgaactcaaactcggagatctgcctgcgtccgcctcccaaatgctgggattaaaggcgtgccgccaccactacctggtcctgaagttatgtatcttaaagcatgtctcttgtttttctaagcacacttcagatttaattcagggcttggtaaatgctgcaactctatatgaactaattgcctcaaatagtaaatttctattatatgcccatcagttaattttaagacttgttttaaagctttgcttgtatgaatctaaaataacacttgttctatggctaattcagttgcactcttgaagtgtggtgtttttctagtttctaaagcagcagttctcaaccttgatattgctgtgactctttaatactctttaatatagttctcatgttgtggtgactaccctctaccataaaattattttctttgctacttcataactgtaattttgctactggtaagaatcataatgtaaatctctgtgttttcccagtgatcttaggtgaccccctatgaaaaggtcatgtgaccccagaggagttgtaacccacaggttgagaaccactgctctaaaggcttggtgagatctcttcactctaatcagagcacaaatgtctcagccctgtgcgaactgtagtagttgaatttattattctctgggagccatttgcccatttctaatggagtcgcatttatatttgtgcagattgctagtcagcattatctcaagtagactgtcttgcctgtctctagtagtgttctctggtgctatgcttcataaatcaaagctgcgccattctccctggtctcccatttctcttttccagctccgccgcagtactgtgcttcgtccttaccttgcactgcactgtggaaaatacacacacacagcctggatcactggacgtctggcttagtttgtttccattctctcagggatcacagccctctgcagcctgttgtctaatgtctgaaagcagttgtttcatgtattttctctgattttctgtttgtttacagttggagggctagtctactaacaggtacttgtttatggccagaagtagaagtgcctcgtgtggttttttttcattgaatgaggtgtgtttgcttgttactctttaattaacagactgttgaattggtgttcatttgttcctttaatgtcacactttaaaagtaaactttcttaatgtagggacaataattacatgtcccactccgccacccctgtgtataaatctgtgagatgatcattcaagtttaacctgtcataccatttagttttttaaaaaagatgactacatctatgagagatgtctacatgctgaatttgtgtgtagtctctttgaagtagaaagaacattacaattgtgacctacatttttttccactggattttcttcactgatagctaagtgttttgatagagtgtaaagcaacattttattagtttctcaaatcccttgctatcctctctttgcagaatgaaaatttcaactctttatgtcatagtggggagtatagaatatgaaaatataattgtccatgtctcttaactgcaattttaatttgaatagtctcacaagatgcatttcttttctccaagaaataagtgaaggctctttggagttcagagctaaaattaagcgctcttttaggtcgagtccccaggacactcagtttttcattctaggcagctctgtctcatctttacatttcctgtgttgtctctgtagatggttagaaaagcaatacttcatcaggttgctgccagtactcctctgtgagatggttattaaaagcatttcctttcctcaccaattcagagtgccaggctttcactgatcttatatactcgagctcttctgacacaagagagagggtagctaaacagctctcaaagctgggtttatagcctttcatctaatttggcctttcagtgaactaggtaaggtggttctccatctttctctacctctctgtcattaatatggttgatcgttgcaaagagctgcagtcaaacaaaagtggaaacttttgtaatttatgtatagctttaaaaaggcaaagaagtgaaggattattgcagttggtgcagtccccaatacaattaatatcaaatgcatataaatcctattagagatctgtcatgggtgaaaaaggaatatgaaaaatgcgtgacctatctttattagattcggttagagagagaccatacagagctaaggagctttacgaactgcatattaatcataaccagtcttctgagataaacctatttcttgtaacttatcaaagccatacagaagattagtcattccctttggtcaaggaaggttttacatattgttctgagttttgaacatcatagcttccaaaactgattaacagatattctaatactaactagatattgaattatatagtttagacagctattatcctataatgacccctcaatagggagatgggcactttgtcaaaacctctgcattattgttttgttgcaaggaggcactctagggagttgtattagacatcacacaaaagaactttgctacagcaagccatagttaaattgtgcagaaaacacttctttcttaaatctttattttaagcaacaattgctcgatgccggccccatttttttaatgtcattttcaattcctgaagtcttttatctcgttgagaaggaggagaattagctcaaggggatggttaagaccatcatgttcatgcactgtagtactgaagatagtggatgtagaacagctatagtctgacaaagataattaagactgtattttaaaaatgagacgaagagagcaagagaatttcacaagattattggactttttagatagcatataagcgtagcagcaatgcattgggttttgttttgttggccctaaatactgagcaatgttgattgtcacttaattaccctaaatgtattaggtaatgctgacaaaaacagacaagtatttaacaatgaagatttttatatttaatgatgtactattttgtagctttgattttgcatttccaaaccccaaaaaagttttatagaagtatgtatagtgaaaaaattcactcttctcatcctatactataaggatgactaattatgataatccctcttagtactttaagagccgatttactgatgaaagtcatagaaagtggccccataataaatctacagctccatgagttatttcaaaatgtctatgtctgtgccatgaacactcaatttaagaaatgaacattgaaatcacttctcaattcttttgacctattcaaatgcaagcactaatttgctttacaatactcgtattttcagctgttttaaaatttaacatcgaaaacatccgctttcatggatttgtgatggcctttcctgtgtttcatataattgaaattaaaaatattggtctatacctgaagttagccatttttttctagaaaaggatagatgctaaatatcgtaggttctgtggcacattagtctctgtcacaaacattcaagttgactgctgtagatggtatagaaatgaatggtatagtgggagatttcattgtatgattagattacagtcaacaaacccattgagctataggcgggcatttgtttttccttttacctggaatactcttacaacatatgttgttgttattattattattactattacagtaattttattttatgtgcattgtgtcttgcctgctttgatgtctgttcaccaagtgttcatgtggtgtccacagaggttatgagaaggttttaaatcccctggaacttgaggtaaacatagttttgagctgttatgtggttgctgcaagaagtcaaaatgctgttagtagctaagttatctctcaagcttcataacatttgctcttttatacatcaatgtgcatttctatttggcatatagaaattatatatcatagggcaagcctaagttcaagtaggaatgttgaaaacttttctaaaaccatagattaattgaatgctccaccagtaaataaacttatcattgcttgtaccaatagtgatttttccaagatattttcctgactaattagatattagacagtatataatgatgttttcattttaatgtcataccattagtaatcctgaatattaatgtatatttggtcaaatcaaaagaaagtgtggaaaatcttatataatatggtagactctgatttaatcagttattcttagtctcttaaaatctccatagtatgtatgatttctagagtgagctgatttttattgtcaacatatgactgatagtaccattagtgtagtcgtagagaaaaaaggagaccatgcacatattaaatagcataatttctgcatacatcctctattaatggtcttttgaatgttgtctttgaactttattttagagtctaaacccaaaaagtcttttctcaaatgtttacctcacactttttgatattacttactggtttatattctctggtttcttatggtcatatctttcggccccaataattttgcctgattcctgaagattttgttcaaaggatgaattttctaccttgcctcaatgcaccaacatttttatctttagactttcaactaactttgcagtcttaccatgtagaccctaactctcatcaagttaaaatatctaaagtgctcattcatacactaagaataaatactggttccactgtcagctttgggagcccctttcctgaggcaggacaatctcttagcctagattcactggggaaggcctaggttctgccccaaatgatgggacagactttgatgattccccatgagaggcctcactcctccttgaggagtggacgggtggtgggataggggattgtggggggagtgggaggatgtgagggagaggtaactggaattggtatgtaaaataagatggtttttaattaaataaaattaatttaaaatatctgaagtaaatttattataatcataattgcctgtccatgtcttcccatacaatcaccagatcaaagtcccaacctcccagattcaccatgtagcaaacagagaatctagaagtgttctgttaagcactgaaaattagcaaataataaaataatttctttccattggttaaatgaaaggtgagtgaaagcttcacattttatgtcttttttttgtttgttttttttgagacagggtttctctgtattgctttggagcctgtcctggagctcactctgtagaccaggctggacttgaactcaaagagatccacctgtctctgccatcctgagtgctgggattaaaggcatgcaccaccaatgcccagctttatgtatccttttttaggaaaggaattgttatattctaaatatgaaatactatgaattttaatatttgttctataaatgtaaatcattttacaaccataattttggtagatgggcaagttaattatagattagagaaatgtagccatagatcattctagttaaagaatggccattgttcaagtctttatagtgttcctaaaataaagttataaatacatgctgaaatttaaaaataatttatccaacataaataagtcatcattatcatcttgaaaaagtaattgctttggataataagaaaaaaaaaaacatgtctttcgaggcagacactgataatgctccaagtttagcttaaatcttttgaggaaagcgtctgctttgtaagattgttactttcaaatatggaagccattatctcatggagttggagtgtcactgaaatactttatccttcctggatatacaacctagaacggcatcacaccaaggtaaatcccctggttgtaattatagaaattaagcaaaattgtaagtatatatttggccctttctgtattttaggtgtggttttaacagcttgtatttagatttcaatggggacagacgtaaaatgcatgtacacacacacacacacacacacacacacacacacacaccacacacacacatcaaatccatgtgcatacacgtaaatgcatgcatagatgaacatacaacttacatgcggtattgtctactttaacagaaaacagaaaattacactggggtcatatacagctataaccaatgaaatgcaatttttaaaattaaaattctgggtgttgccttccatagtgggtcttcagaatctgtcatatcctttgcagtagtgtctagggccacccccttgtgcctaggctcagggaatatccttctatgtggaatgggctcccaaagtctattcctatgctagggataagaactgatctactacaaaggccccatagatttgaggtctcctcactgacacccacgttcatgggggtctggatcagtcctatgctggtttcccagctatcagtctggggacaaagagttccaacttgttcaggtcagctatttctgtgggtttcaccagcctggtctgaacccctttgctcatcactcctccttctctgctgactaaagggtataggataggtagggtgttagttgtcaggggggtaggggaggaggggaggcagagggaactgggattgacatgtaaaataatcttgtttctaatttaaataaaaatggagagaaagaaataaaaaagacagttggattgttacttacaaaactaaacatactcttatcatatgctcaattgggttgaaaacttctgtccatgcagacacctgcacttaggcctggggatgtgatttagtgggagagttctcacttgcataacattcaggaagctctagtttcaatcctcagtattgcaaaatcagtgagagacagagacacagagacagagacattaaaacctgcactcaatgtttttggcagctttctcttaaaaaatactgattttttatattatatgaattggtgttctgccagataccagatcccctggaatagacagttgtgaactggcatgtgggtgctgggaattgaacctggaagagcagtcagtgctcttaaccgctgagccatctctttaaaccttttggtagctttcttaataattgtccaaacatggaagcaacaagatgtccttcaatgggatttttagtgataaaaagaaattggctttcaagccataaaatctgaaaagaccacatattgtacaattataattatgtgacacacttcaaaaggcaaaatatgagcacagcaaagaagattaatgctgaggggagagggatagatggacaaataagcagagactgtgaaattttaggagagtgaaaatattttgtatgaaactgtagctttgggtatgtgatacatttgccaaaagtcattaggtaacaatctaatgtatcagcctagttgtatgtttatcaattgtcttagggtaaaacaattctgggtgttcttacttgaatctcgctggtggattattataatagaaaagagaaaaataccagcaaaataatatatatgtaaatgggaaattccacagatagatcagaatactatctgtggcagaaattagtaatattagctttttaaagaaaacaatcaccaaaccttctctaaaagcacatctgtatttattccaatggcaggtgacaacagtggaacaaagagctgtcttttcaaatttcacttcctaagctttccgtgtgtctcagttacagtgatggtgaataatggagaaagtcagcacaagggcagattctgcgtaattggaaaagataatttcctatactgtgtgatttgaaggccacactaagatctcatctaccatcctctttccataactagacacacccacaattattccactcaacagataataataacattaggagtaatatttctaaacagtcactattacaatacctatacaatgctttgcctagattttccataaaccttcttatattctctctctttctatttatacattagaaggtagtgctccacaagaactcggttcaggttgaaggtgatgagaattttcagtctgagtcagattgcatgagagctagcgcgatggtggcagtgttctgttctgaacgcctgtgtgacagtcacacaaaagcccaggcagagcactttttcagagtggattgtttcttccggtcatagtccttcatatcaccaaaggattcaaatgttactgtgtcatccttagctataatattcatctgctgagtggtttgcacatacagtcccctcagatatgatgaataaatgtaagcagacttaataaccactatataggatacctctttgccatagtccattctttgttccagctttgctcaaatgaagcctatttcaaatcatccctttggaaattacaatcttccctcacgacacttcctgtctctctcagtttttgtccatagcacttatgcctgtgaattttgtctataaatataaatctatatgtgtgtatatatacatgaatatatatttatgtgtgcacatggatgggtttttgtgactgtatgttttctttaatctgtcccctcttaaatgcacactgcattacaaattatttaatgagaatatctcattattcctagactgtttttcttccatgtcataactgaagagaaacctccttcttccaaaataaacaacttgcctatttcagagtagcaatctgtgtttgcactttttaatgtggttagcatgtgagtattgtgccccaaacacatatcatgagatctacacttttaataatgttttaagtatgcaaaagaaaattgattgctgtagatgcattgctatacaacatattttcaaagggttttcatgtagcatgactgaataaaatcactgaaaatgaactcctttttgcttactcattatctagcacccacggttctactttctgctttgattaattgattaataatttgactgatttgggtacatcctgtaaatggtaccctatagcaattgtctgtcagctaattccagttaccataatattctcccatttatccttgttatagaatataacaggatttccttttatgtggctgaataattttctattatgtgtttctatttaaggaagagactattctttctccattgtgtattctacttttgtacaatattagttgagtttatgtgagaaagttcatttctgggttctatactgttgctttacccaattttttttaacggcaataatatcatcagtctatatttgatttatattcctattttatataccggcataactggcactgtgtattgaatggaaaatgttggcacttagagaagcctgttgtcagagggatatctgttagctgaatgatgtgaacagattagccatgtgaataggaagtctctttcaggctaagaggaaagttgaaattaatttaaaaggaccttaacattagaaagacattaacatggtgacagaagaggaagaaagtcggtatgattgtgaaagctgtttgtggaccatgtgataaggatcacacagttaatcagaagccaggcctatttggccaatgtacaaattgatttaaaagtgttgttttttcaaatattaggatatttgttttgttttatcctttgctctttttttttcctccgggtgaagctgtagagctgactaacctttggcatgagtttccatctcagtgtctcatgtcttcacatgtggtgatacagagtgctttgtgacggacctcataacagagtccctgtgcagacaggagtctagaactttctcatttgctacatgatatgcagtgaatgatgatcagatcatgtctcacgtctactgagtcaatcatttcatgtctttgaagtcccatagtttcttttctactggaggtgaaatctgtgacctccctgtggacgcttggccccttagacagctgggcatttagatgtattctgtgcttccaatgcatacttacatgcccctgacaaactttggtttctaaattaggttcagtaagaggttaacaagaactaagagtaaaacagtacatctgtaaaaactactacaatacaggtggtccaaaatgcacaaattgcttattggtatgacttttccattaagcatttcatagtgctattgaacttgcatggctgaaactggaaagcacaaatctatataatggagagctgttattaaagattgaaattataggagaaacactgaaaggaatgtatgaacacttcttaatttttaatgatgaattctttcaaatttcactatggttgaaatgtaacttttcaatattaagtctagtatcactcatctttccatcattgtgagactttgtgtctctatacatagctttttgtagtcttcgaaaatgagagattggatgtaactgacaaattttctgtcactaatacttgtactgggtctgaattttgactcttaaaatgctattttcactctaaaaacattttaaaggtacattgaaatttttcattctttttatttatttatttatttttgagacagggtctctgtgtgtaacagccctggctgtcctggaacctggctggcttctagcttacagagatacccctgcctctgcctcctgagtgctgtgactaaaggcttgagccaccaccaccttgcacttaactctttttctaaggctttgtaaaccatgtgtacatacaagtaagtctcccacactcaaggctcacaacaggcaaaattttcttgtctctttcagatttctctgtcaaatacattgttttgactgcttttaaacatcatgatgtataacaccaagttgtaatttcttagtcatgactgtgcaagtttctatactactctttgttagattgcatatagatcataaaatacatttaaattttctgaaagacagcctggcttggtagtacatatctttaattatgggagagagaggcccgtagatctgagttgagtgtcagcctggcatacatagagagttccaggcccaccaggtctacatagtggaaccctgtgccgataaaggaaacagaatttataaaagatgggaattggggacattttctggctttaagaatccttccgattcctattaaatggtatttatattgtaaatttatctcaattatgtaaacataactgttatgtaatgacagcaatcaaaactgaagaatattagatctcattttctcaatgatgtgcttttctctacttaccttccaagtaccttcttgcttgctgtcgactgtacatgtgactaaaaggaagctgagcctagaaattgttccctagtactgtttgattaatcagaaggtgccagttcaagaatagtttagatatctttgagcatacattgtaatatttattgtatggaggcaaggagctaaacatgctggtattcacaacgactgctgcttttgtacctgtggtaatgacacatttcagagcaagagagcctgaaagtttaccttctgctcacttcagaaatcattaggaatattttaaatgatcaactcattgctggaaaatcaagaaagtctttggaaaactagaaatagattcactttatcatacctttctccatactcgtcagagcaactgagaggctaggtgtgaaggtaaaattgcacacaaacacacacacacacacacacacacacacacacacacacacacacactagggagaaatccaggtaaatgctatttgattggaggctacaaaaggctttagaaaaggagaaataaaaatagaagtgttaaaagaaaatagttcttatttctagtctatatgaaaggggaccttttgtaaataatatgcagtattgaagaacatgtggtgaatttgaagcaaatttagaaaaaatgataatataggaatacctttgtgtatttgttgttatacagctgaagaaattaataccctaatagtggatgatttgtgagacagtgcatttcttgaaagaaaattgtgtgtgaaaatagaagccatggaaatgtttataatgacaccccaaattctctttctagaaaaatttcccaaagaaggaaatgagcaaaaatgatagctaaggatatttaatgttacatttttctcatagtaaaaaaaaatctaggttttaaatgagttaagaagtcattacatgttaattgataaactattacataattgaagatattctatatacttaattgtatgtgatactttaataacatattgaatattttacatttatgtttcttagtgttttgcaactatatatgtctatataccacagtgttatggatagttgtgagctgtcctgtggatgctgggaattgaaccctgtgcaaaaacaagtgctcttaactgctgagacagctctccagcccctttcattacatattaaacagaacacattaaacagaaaatgcatatagtatgaaatcaattaaaaatattttgcacagggccaaaaaggatagattatgtgacaaaatattaatagaaattctcttcagatgagaaaacatggtgacttttatttttgtattttgtgttaactatattttctaaatttcccttaatgtacacatattcgatttaaaataaaacaagaggaaataaatgataatgtacttagattgtattatctttattttctcataatgtttatgatatagcaattacaaatttaataaattctccatctctgtctttttttttgccaagggagctattatttaaattccatttcattcagaaaacaagaaatatattttctattttttgatgtagtggaaagggatgaaggagctgttaataagttcagatataagcaatataagtatgttcaatgtgtatcctattaacttgaagggaaaacaggaatctgtgttccttgatactttccatctcatagccttattgctttcatcatgtctagttttcaatttaagatgcaccattatattagtaatttatttcaactttatatgtgggatgttgtatttagagaatctataatgattgtcaattcaaggggaattatcatttagaaatagtttttgggtggattttgtctctttttagtagactgggaaagtaaaagcaatgccttctaaggggaaatagtgcaaacagatgaaatttaactgagcactaggcatagaaaatagaagagctcatgtgagggagattctatgttcttaaatgatgaactgtttggaaatgagatggtgtggtacagatgtgaagagtaaaacagaaacaagtctggtagctggtaacatcttcccatctgctctttgtattacaaataatagtcccattgtctaagttcatggcaatagtgcttcaaaaacagacaaataaatgcttcatagtgttatctttggcttatgtaatctggaagagatgataacatcctgtgttgttgtaaaggaccagtagactggattaatttccctacagatgttcttcaggatgtttcttccacatttttggtttttctcaaaagatacatctcatgagtgattcaggaaaaatgccagtggatttgcatttgtgaggaattgagtcctctaattatttatggaaagcttaaaaatgaatgtgtaccacattttacaaatggatgctgcatgccagctagcacaattgtattgcttaggtgcctctcttaatgagaggtatttactagtttggtaagtgtttctcatatgtaatgacagtaaaccttcccttcttccactagtagtaaatactttctagtgtcttccaaatcagatgaaagtttcatttcaaaaatctcaaaagcttgttattagatgactaccttagctttccttatttttttttttactatttttttattgcaaactggtggaaagttggaggtagaaccaggttgaaaataggtccttgagcagtctttgtggtctttctctctcttctagcttcctggtaaacaatgtgagcaccttcttgcagtcacatttacaacatattggtgttctttgctcttgcccagttcccaaaagcagtagagctaactgactagggactgaatcatctggtacctcagccaaaatgatagttccttctttataattacttttccccctcccttgctttcccttattccctgccacttcccctccttcctacattctttttatctcaggtatttgtagcagcagagtactgagttacaaaaaaaagacaccactaaatgataaaaaatggaacaatcattatagcatgttaatatcagtttgctagtgctgagtaactgccatttagggcagagtcaatctgtgttcttccatataaactgagcattctctctcattcagtttgtctcacatgagattgtcttagactagggtttttcaatcttcctaatgctgtgaccctttattataattcctcatgttgtggtggcacccaaccataaaattattttgttactacttcataactgtaattttgttgttattatgaattgtaatgtatatatctgtgttttgtgatggccttaggtgacccctgtaaaatcatcttttgacactcaaaggggttacaacccacaggttgagaaaccactggcttagaccaactgagatggtatggcacatgactgatgtgacagcatattagagctggaatacatcgtttatcccaatgtgacctttctcttaaggggaagtatcttgcccaagtcatagagctggataggcgaaagtagaataatgcaaattattggatggaaagaggtagtatttggattacatgggggaatgattaaatgtttgaaaaagaatagttattaatgatacatgaaacataatatttttattaagcccacattttaaagagcacatttggggactaattttcttacttcaatatttgcataaaaatagaaagtgatgtattaaaacagaacatttccaggaaaaaagcaaggtatcagctaatgtatattaatcaatgagtgtattcatggtttcaatccatacctataaactatagtttctgtacagtaacctcatttagttttcatgtttctctgtgtacttgtgtcagtaatatgtaaatgtacatatgtgtacatgttggtgcatttgtgtggggttcagaggtcaattttggctgttgatttttctttgcaacagtctagggcctggaactcactggttaggtaaggctgactagccagtgagccctatggtcttcttgtctattttttccaaggactgagattacaaatagacaccaacacacatggctttttctatgggacctggagagcaaatataggccctcataattgcacagcaagcactttatggactgagctgctcctcagcttttttgagatgtataatacttttgaaaacacctgaatatactattgttgagcaagggagaaatagctaagaatttagagagagaaaatgaagatctcgtatagcatattgtgaatagcaaagtcgtagtgttaaggatgctatttcaaaggacgattattgtatctgttatattctattaaaccatagtccaagttaatagaccatgtaaagttaaaacaaaaagaacaccttaaaagaactggaaggagaatattcaggggaaagaaaaagaattgtttgagagggacaaagccttcatagaaaaaaataattatgtctttccaacatttttagtgttaaggaccctttatactttcaaaattattgcaacctgcaaagcctgttctttgtatcatttatgtatcttgaaatttgatttaaaaacaagaatattttagaacacaacactacagaggaacatgctctatttacaattagaatagctgtggcatcccaggtcaggtagcctctggaaaactaatgcttttctcgtctctgcatttctcactgcatcagcttcattttctcttgtcagagggagatttctttgtctggtaggggtcttagttattaccagcagcaagaacatagtagttgtgtttggatacaagggttcaggtgatattgttataaatggatagaggagttgtttggttggtaatggagtgaatttttccatgctataaccttctttcttctttagaaaatcacagtacacattgtcatgatacataatttgaagtaacatatgatagaatgcttaattatctgtagttaactcactacaccatatcttaggtgatgtcattacacatatttataagtatctcacaagacactagtatcccatgagtgtgggaaatttatttcatttgttgtaaaattttaattccatttttacatcatggagatttctaatcttctgctctactccccttttcatcatcagacagattgttgtgatttatgagaataagaaagagaaccatagctatttttgcaaatatgtatgtgtaatttggtgtaatgagaccatatttttctgaagaaaattatttaagtggtatgtttgggttattcatgggagacagaaaatcaaatatggtaacaatacttcagtatgtattagcaaaaggcctatgatatatttcatgtgtttttaataaatatattaatataatacaaaaataattattttttcatgataaatgtagctacctgaaagcaatatagttattatgcatactgagaaattacttaattaattccctttaagatcagaggcaatatcttgatgtttattgttaccagggttaccagtattgacccatttccctcttttcctgaaaggagaggacaacgtgtatttgccactgtgattagagaaatatatactttataaaggaatacataaaattatatgaatagctgataatagatataaaatgcataacaaatagcaccctaagcagtcattaacaaatgtgagtcttatttattataacaataagaaagaatcactatcaataacttttctataggattatttctagggactgacaacaagatgtgaaattttcactgtttgtttgcctttcctttaatggctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtgacataaccttttctgaaaacctatcacattgccagacgtttgaaatgcttcatgttagtgtgatggagggagacaagctctgtgtttttcttagcaccatctttctttcctgttatcattttagagggaaatttcatgacaccttccaaaatttggcgcaataattccagtccttgagattcattccctgcttttgtcgaatgcaaatttgtgaagatgtatgaacaagaatatcagatgtaatcttgtccctcagtagtgcattggcaagccacgtcttctttactttatctttggttcagggtgctgcagccacactaccctttttaattcgggaatatgccaggtcatttccactcctaggacctttgtactatcagatacgtttggttttaatacttcttcccttgtcttattccatgcctgactttttcttgtttttcaggtctcaagcattacttccttaaagatgctgttcctaacttcccaccataaagtggctccacatagttctctgtcaaaatgtggtccacatagctattactgtttattgtttactttcctgtttatttgctgtttttctgaaaattggaagagcaatatacttcgcaattaaaggcattggctgtaaagtcaaggctgggttcatgtcctggccctgccatttactatctctgagcacttggggacaatttcagcttaatccccatatggttcactttccttatctgtaaaactgtgtaagaatagagcgtatcttacagacttgtgagaattcaatgtactttaacatctgtgttacttactttctccttgctgtgataaaatacctcacagaatcatgttaagggaagactggatttatttcggggcacagtttgagaggaaagagttcatcatggcaaggaaagcatggcaactggggcttcatctgtggatcagggagtttgcagcagctgtttgtttcttggtaccaaaccaagaagcatagagggtgggtggtggtagagagttgaattataaccctaacccccccttgattattgctcttcactttctctagttaggcgcaacctgctaaagattctgcagcttctaaaacaatgcctccatttgtagaccaactccctgaaaagtcacattcaagccctagtagcatctaaacccattcaaagcactagttttggtatgttagaaaaaaactccaaaagatacaaatgaccaagcaaacaaaaacagtctacttattgatccagcaaattagaataatcactcatcaaagtgctattttggaagtgtctcagttaatgaggtagttgggcatgtgcagatgagaatctcctttagaatttgctatcagtgagaatgacctagagcatacttcaaatctcagtgtcacagctattttctgctaatgcagcatgccatcatctgccactgaaggtctctggctcatattatgctcatacaggatcttatgctctacatatagcaaaacgaagaacaagacactgaatgacatcttactacttatgttaggaaagaccatccttcacttatactcatgttgcattggctacatcagagaactacatctgatttgtttttttttttactttggttatttgctgtattttttaaaattaattaattttttaagcattctaatcccagttccccttccctccttccctcccattcccttcaattcccccttctcccatctgctccacagagatggtgaggcctcccctagcaagtctactaggtctgtcccatcatcccgttgaagtaggacaaaggcatgtctctacccccacacccctgtgtctagactgggcatggtatttctccatatagaatgggctccatataaaatttgtatattagtgttatgtcttggacccactgctagtgaccttatatattgtctcagtcacaccattatcacctatataaagggagtttagtttgttcttatgcaggttacccatttgtcagacctgagtcagtgatctcttaatagctcgggtcagctggttctgtgagtttccccatcatggtcttgactcctttgttcatatatttgctcctccctcactttgattgtactccaggaacatggcccattggttagttgtggatttctgcatctgcttccatctgtttctggaagagcgttcaagcttctctggggttatggattgtaggctgggtattttttgctttatttgtggtatccacttatgtatcagtaatactgtatttgtcattctggttttgggttacctaacttaggatggttttttctagttctgcccatttgcctgtgaattttaggatgtcattgtttcttactgctgagtagtactccattgtgtaaatgtatccaatttttttttatccattattcaattgagggacatctaggctgtttccaagatctggctattacaaataatgttcctatgaacatagttgagcaaatgtttttgtggtgtgaatgtgcctccttccttcgggtatatgcccaacagtggtattgcagggtcttgaggtaggttgatccctaattttctgaggaaccaccacactgatatccacagcagctgtacacgtttgcactttcaccagcatctccagcataagctgtctttggtgttttttattttagccattctgatcagtgtaaggtagaatctcagagtggttttgatttgcatttccctgatgactaaggatgttgaacatttccttaagtgcctttccaccatttgagattgttctgttgagaattctctatttagatctgtaactcatttttattgaattatttggcaatttgctttctagtttcttgagttctttgtatattttggacaccagtcctctgtcagatgtggggttggtgaagaacttttcccattctgtagggggcgcattttgtcttgttgaccatgttctttgctttacagacacttctcagtttcaggggttcccatttattaattgttgctctcagagtctgtgctactggtgttctatttaggaagtggtctcctgtgcctagctacatctgattttaaggaggagggaaacacaatcctgtcctcttaaggaggaacagcagaaatttgggtgagtgacactttaacaatattaggaatatattaggaataaaggtacaaagtaacaagaatagtttcattggatgtatataccatcatgcatcatttaattactgaaatatggcattatctggtcccattgtcctatgaatattctatagtattcttagacaaacctagacttagacttcctagtgtacttatttttaatgtattttctttctatactattttgatttttaaaagctaaaatgcaaaaccacactatcccaggcctagacaaggtcaatttaatatcaacatctaccactgtgacctacttactgttctcatggaaggctgataggtgaataacatgtataacattcactgtctccactgccaacagtgccttctcctagattaactcctgaaaatcctgcttaatgttgttttacagttaacttttgattaataagtagttttcagtatagtaacaataataatatattatagcagttttataatccatgaatagccacttcttatgtattttacatccttgtatttgtcgttttttcatacaagtaggattataataggttttcttttatatcaagattaccacaaacattagcaatacattatattttatatacctaggtgataagttttctagtctattacagtcttactttccttttttcttttggtttgatttttgccagagcttctctcttagccctggctctccaggaagtcactttgtagatctggctgacctagaactcagagacctgcctgcctctgcctcctaagtgctggaattagaggtatacatcaccactgcttggccctttatagtcataatgggatcaccattatatatttagggtatccttgacagacctgttagacagtatgagacctacataaaatttttaataatttttttcttggaagtgtataaattacaagtgtgtgtgtgtgtgtgtgtgtgtgtgtgtgtgtgtgtgtgtgtgtcatctacttgtgtacttgtgtatatgcatgtgcatgtatttagtcttactatgtagcccagttatgctagtcctttctttgtagcgcagcttagattatagatatgtatcacaatgcctggtgaggcatttgtcttttacattataccctgacatatgctttacttttgaacattcacatattactttcatagctaaaatacaattgtttccttactgcctcatgtatactttggtaagaggtcatagcaaatactattacagtttaattgaggtgggatggtttgtaatatatatcaaatacagaagtaactaatgtaacaatgagtggtgtgtacagggtctactaagtgaatttttgaagtatgattatcaatgtgaaatttaataagtaaaataattctttttatgtgtgtgtatgaggtgtgtgtatgtgtgtgtgtgtgtgtgagagagagagagagagagagagagagagagagagagagagagagagatgatgatgatgatgatgatgatgatgatgatgatgatgatgatgatgatgatgatgatgatgatgatgatgatgatgatgatgagtatcaaagcaagggactcagacatgctgggcaagcattctaccactgagatacatcccatttcaagctcaatgctgaagggtgaaaaatggtagaagaggttaatatgccaaagtttcctagtaacaaaacttctgggtagttaattgaaaagcctgtatgagcagaccacagaaatatttttatatcactttgtacttggatagtaatatgacatgtagcataatatatttctgaataaatatttgcgatctttgcctgaccttataaatttgttcctggcagttattccagagcttttcttagctcagaagttttagttttcgtacttcttggagagtaaagtattaaatgatttttaaatgataatgttagaagttttatttaactgttcttctcaagttactttgatagaaatatagacatatggttgtttataacctgcaaataattggagaagtattcttgtcggtagagatcaccgtcctctaacatttttctgtagtgtcttagatatatacacttgttttccttggtattttattttttatttgttgaatacaaattgggttgtatcatgaagaagtattttgaaataggtgtcatcgtcttccactcctcaagcttctagttattttgggttttcttttaatagctgcttgtgcataattaatgtttaagaaaatgaccacacattgatgtccacatacacatcaaaatcaacatagtgaaaaaaactcatacacaggtttccagattctcttgaaaaattacattacttatttatcttgtagttttctatgtgtacatgctcgtgtgggtgcggatgaacatgtgctatttatgcaggtaggtgtcagagcaaaccttcagggagttaattcgtgtcttccacaatgtgtataaggaataaaaatctcaagatatctttatatcaaggaaatttacattttactgctttgctctgctgagaaatagatgtgacacttcagttgtacattaaaatgtactcttgagaaagaaaaaggaaaagaagttttataaatatagtcttgagaaaactgatacaattcagagcatatatcccagaaattaagagaaataaaacatgattatgaataattattacatggtaggctcgacgtgcttttactgtacaaagtgatttcatgcgctccacaatgagtctctgaaacaaagaacatggtctctcctctcttttgtggctcctgggggaggctgcacaactgcattaaaacccctaaagattgctgttttgcatggaaattcatgtttgatggttttttttactttccctatgagaagcagctaagggaatttggtaatcacactttccttatcttatcaggtctaaagttaaatcagaaagatctatagaaggatttctgttgtacaagaaaggtggtgtgcaaacacagtacctgatcagcgagctagattttgtaattgctccactgttgttgatgatgacatcttacccatggctatggtaaagaccttgagagccaggcagcaatttatgctctaaattcttgcctggtagggttgtataatctaatgatttagcaaatttttggtatcaagagtttacggtactcataaaatgctgtttggatatggaatgaattttctcttgataaatgaccattctcaaaggcatattgatttccatataattatatagctacttatactttagtttattagcaaaaccgtctcagattttgcataatttaatgaatataattaatgactaactattcttcttttctctgataggctaagtaatcaggctgacctagactaattcttcatactcattacagagcaggaagggaggaacggcaaagtgttattttgcatgatagctctgtttttctcaacttcctattacagacattattaattttatttgaagcagtattaaaggtatatttaaagtaagggatagagatattataggtaaaactgagaaaaaataaaatacacatatgtgatgtatccttttccttacattttcttacatgccaaaataaagtaatttctctgagacgatattaattagtattttaggcattttccattttacctttaattactttttaatttaattaggtaaatgtggatatgaaaatgtgaagtatcaggcatgttaggcaatgacagatttccaaatgacctttatacatatcttcacagtttaacatgtttacatattattacatcctgattggtgtgtgtgtgtttgtgtgtgtgtgtgtgtgtgtgtgtgtgtgtgtgtgtgtgtgtgtgtgtgtgtgtatctgaaagagcagctacaaacttccaggtaaaataatgagtcctcaggtttggacaaagtacagaaagaaacccaacaaatatttaatcattgtaactccttatggattggacctgagttcaaatctcccagatttacatgaaaggctagacatgactacatgtaaaaacaaataagcaattaatttcttaatggagagaagcagagtttttaatttctcttacactgatatagtgtgcccagaagtatcagctgctttaaattttgattacatttctttaaataaaatgaggaatggactttggttataaaattctatgctacttttaagaacgaatgaaacttagtcatacacacacatttcaggttagtttttgaaaatttcagaaatgtatacaaactatttattccccttcaactcttccctggccaccaccctccaccccacatcctgttcccaagttcagttcttcttttatcattatgtatacattgttctgatgtggttactgggaattgaactcagggcctctggaagggcagttaatgttcttatcctctgagccgtctctccagccaccccaaggtcatctgttttttaagtttggtaattttgttttttttttttttttaactttacacatgaccactggatctacgtcacttcaacctctactccaactcctcctgtgtcccgactttcaaattaatgaatgaattcttttattattactgttacatacagaaatacatacatatatatgtatatatatacagatatatatatatatatatatgtacacacatacatatacatgtatacactcacacatatataatatatatacacacacctatagctaagacaatttggagttcccaagcctctccctcctgcctggctactatataaacccccttctctctcttctctgagtctctccttctctgttcttgtcactgatgctgctgtttcagaaagaaggaggggcccgtgttaacttgagtccacttatttttttcttgtatgtacatgtatacaagtttgaccacttggaattggacagcctatgtgggagctacttcttgaaggagactgattctccatttccaagcaggcattcaacacaagtagatcaacatctaggggtagaatgatgtggaatttccctgtccatattggcaagtcaactggtattgtcatggtggtcttgttcaggtaatcatattattgagagggaagctgtacctgtgaactctcaatttcttcctggttcctttttcttttactttttttttttataactcattgtgtctaattagtgctgcagctcatatactcatgggtgtgtgccatccacttcagcattgtcaacttaccagggaccacacccataaataaaattgactcacttctctcaagaccatctgccaatatttcagatagggccgggtcttgggtatccctcctcaatgcatgctgtaatgttagttttgtgtaagcaaacacagatgatttgggaattcatgagttcaatacccctgtcatatttagaagaattttttcctctagtcttccctgaactctgtcttttccttcagtgatattccttgattattgcgggtagaaggacatatacctagaataattgtgttaattggaaaagatcattgtcagtacatcaaaactgtgaccattcttagattttgtatgcatgatttttaaactttgttttctacaatacaaatacaatatatgttaagccccaaaccacaaacctgaatcataaccttgagatccactctaatgcaaaaatagagtctttattcgcaagttaacacgggtccctccttctttctgaaacagcagcagcagtgacaagaacagagaaggagagactcagagaagagagagaagggggtttatatagtagccaggcaggagggagaggcttgggaactccaaattgtcttagctataggtttgggatttgctcaagccctccaaaattgcatagttacagccttgggattggctgaagccttccaaaactgcatagttacaaccttgggattggctcaaacccgggtatctggactgggctggttggctgcactgcgtctagggaaaattgcaacattgttgtctcataaggcaggcacctggagttgtttactcatttctgattggcctcttccttgtggtgaggtgttgctggtttctggtgggcctccatgggctagggtcagtggaaagatagggacagtcaggcttgacagattggaagaggctgcttcctgctaaagtcagggggacagggggacacctcaaccaggggctactactttcttagattaaacatctatggggagtgttgctcccacactagagtgtactacttccctaagctggggtcaggaaagggtatgcctctagacttgaggttactattcccctatctccctgggctggaacgttcacacccataggctgagggtaactactttactgctcagggattggttgattttccctgctcaaggattggctggttttctgtcaggagcaaaaatggctgtagtttcagggccaaactgtgtttctttctgtggttctttttagctgttaggctccaattttagggcctgggagaatttttttacaggttccgattctaggggcaaagtttattcttttagagttagtttcagagatggggtgtttttccctggcgctagatttgcaaataaagtgcctctttctttggctcaggcccggaatctaggatgtgtttcttttactcggttgaggctctggggctagccattcaggaacagtgtagagtctaaggatcagggatttgctgggacctgggtctcatatattttcctactgatcattaattcttatcaggcaccatgctactactatttcacatgctcctatttaccagattccctcattatgtgcctggcagtagacactataatcttcaactttcaagttgggggattctgactgcgaatttaagtaagctacccagttagttcctctgtggtgagcttggggcttattttgaactcaagtaatgtttctgttgagtacttgtgctggtagtaaatcttgatctttggagtgtggaaataatctttgggaatagcaaaattttttggctttacatttgataaatgagcgaattgatcatgccctgcccttaaaatataaagcaatgagatgtatatttggataaactatccccggagataatttcttcatccaaaaaaggcttttcaaaaactgtttcagcagtggcaacgtaattatagtaagtacattgcccctgagataactgtggtagacagcacaactttgaaagattaaggtctgtttgttcacaagcaaaataggcttcttattttatactcagattttgtgatggcagagtaaataactttcgtgtcattatctaattgtatacattgttttaagagatagaaatattgtagtagagtacaaaaccacaccatttctgttagtgtgcaacgtttgatcatttctaagggaaaattacaaaactatttagctcacctcagtttctatagcacagcctctaaagtctcatttctttaacagggccttgtgggtgttctaaaggaatgattgaaatgaaaagaaatgagagagtcaaacagtgtactgtaatagatgaaatggaaagtaattatgttaatgttgactcattatgaagccctaaccgtttgtacctgctcatttctgtgtggaaacctgtgcagctgagatgctgaataagaaattcttgtataaatgagcctagaggcatgtttctaatattggagctaagcctatgcagaattgtaatgaatttccctaagtcagtgtttaaatgtgctatcagagaatgtgcttctcttgacagaaaatttggattctactgtttaccatcaaaattttacctctgtgtttgaatcctaatagctgaatataactatcatttgtaaattgggaggagagaaaaattctcaaattgcacaatatatctgtattatatgcagtgtcagtgtcagattttctaagatatgctcatgtagacatacttcagataaattatacagaagagatgtatgagataaagttagcagggcaaaaggatgcaggtgagtataactttgcaaatatgtatcctggaccccttcataaggaagcagttgtaaattactcaagcaatttgaccacagggtgtctggtgtgtttgtgtgtgtgtgtgtgtgtgtgtgtgtgtgtgtgtgtgtgtgtgtgtgtgtgtagaagttatatctatttacatctttgatgatatatgtggtgcttaagaacatggcatttggggttgagccaactagatttaaactgtttgagtccagtactgaagcttttgttcagtgttagagaattattgtgtccattccctaaatgcttcagtctccccattgtacatgaatgtttctcccttcctataacatgttgtgcaagcatttgcctttcagctatagcttagtattaaatgtccttaccttttataattcaaacgagtcctgtctttattccagacataaagtattataggatctctgtgagttgttaccctgccaattctggtttagttacaattgagaaaatggtacattgctatttgtaatttaaagagacttaattttacctctgtgccagggagtatcttcaaaaacagtgaaattactaaaacaacgagacacctgatttttgtcaaattaggttcaccattaacttgagattttaattgcagcaaagaatattttactttgggcatgaacttttctttcttcttgtcagtccaaatgcttttaagtaatccacttaaatttaattttctcaaaatgagtgttgatgctgataatattcttttgcatgtagaggtaattaatatcaggttggtattcagtgtcactctactttgtttggatatctgcttttagatttttgcattactccgacaaagatgcaagacctatttagactttaacagtgaagtcttagcatagaatatcctaccagaaggagtgtaaaaatttcatctgcagcagagctgtctaaaagaaatacaatgtaagccacatatgtaatttaaaaatttctagaaaccacatttaagaagtgaaaagaaatatccaaagttcattttaataatacggtttatttctatatctagtcaatgtaaaattattgaaaagatacatcacatcattttatactaagtcttcaaaatctgctgtgtatcttatatttatagcacatttcaattccagccttgctgcatttcaagtagtaggcttctgcctgtgaccagaggctacctggtttggcagtgtagacctcaagtcctgatttattttctatccccatgttcctgatgaaatgatacactaagaatagtgctagcatccttcctgtggaggagggcatgcttgtctactaaggcattatcagaaaaatcataatttgtcttactgacttcctggttttgtacacgaggaataaagactagattcattaaaggccttttgttttgcaataagttgattctcatggatttctttctattctgaaatttcttttccttttttgcttgctcattttagagatgtaattttcctttgtttcccatgacatgtaagaatggagatcatttatcaaaaatgacaattgtgctgatgttgcttcttggacaatttttatttactatggtgagtgtgtttatgtatgtgtgagtccaacttgtgtgtggtggaacaaaggtcaggggacaggtttccagagttgcttcttcacttctgttgtgaaatctgaggattgactctaggttctgtatgaggtttgtgcatcaagcactttttacctgctgaaatattttgccatccctgtgttgtttcttttagtaaatatctgaagctcctgttatagtttggagagaggttgagagtgttcaccagtgattcatgtgcagtagccatggtcctcagcatggttatcctggaaagttgtagtgacatatataagaggaggaccttaggacatttgagtacctgctcttataaagaaagttcttttattttaaattaaaaaaatatttttcactttacataccagcaccagttcccccttccttatcttctcccaccccctgcctcccctttctcactcctgccactcctcagagtgtgtaaggccttccttgtggagtcaactaagtctgacatatcaagttgaggcaggaccaagaccctctcccctgtatcaaggccgagcaaggtgtcccccaataggaaatgggctccaaaaagcacattcatgtatccaagataagtcctggtcccactgccagggatccccaaaacagatcaagccacagcactgtcacccacattcagctgtcagtctagtgtctgttatttcccgctagatagggtcagctgtctctgtgatttcccccatgcagctcctgatcccccaaccccttgttcatatgatcccttctctctttcttcagctgatctccaggaactcagcacagcactttgctgtgtgtcactgcatctgcttccatcagttactggatataggttttataataacaattagggtagtcactaatctgattaaaagggaaggcccatttggacagcctctccattgctaggagtcatagcagggtcatccttgtggattcccgattatatctctagcatcaggtttctcccataccccataatggctccctctatcaagatatcttttattgctctctccttccttccctcccccaactgtgtcttgattccttatgtttccatcacccatcccctcccagttaccccctctccccagtttacccaggagatcttaactatttttccctcctggggctcttcatgtgtgtccctcttagactcccctttttacctagtttctctggggttgcagattgtagtcaggttatactttgctttacatctaatgtccacttataagtgaatactttcactcaggatgtttttttctagttccatccatttgcttgcaaatttcaggatgtcatttttttttctcctgagtagtcctccattgtgtaaatgtaccacattttctttacccgttcttcaggtgaagggcatctaagttgtttccagattctggttattataaataatgctgctatgaacttagttgagcacatgtccttgtggtatgattgtacatcctttgggtatatgcccaagaattaaagttcttatggactctagaatgagttctcctcaataccatgttcttacaagagcaagatctctggtttgttttgtcagcatgatgacaccttctcacatgtcttcctgccctgagacctcattggatgctgaaccaaagctacttgatctgtagctttcaattttctttgtaaacatttcctactaggcttaggtatttttacatgaaaatgaaaaatagtcaaatgcaatctctatgttgttgaagccccagtaatcatttaagctacattctcttgaaagttccactaatcacaaccatttgctttgcattttgaacatgaattactcatctaatctcttgatggaaaatcatctcctgtcttctttactgatttacaatactatataggtcttttgcaatgtgtgttctattcatatacatagtcttgccttctactttcgtgctgtttaaaattccctgttaaccttctcatgtgactgttcattaggacaaattgggaaaggacttgggactgaatgaaactggattcttctttcgttgaccttatcctaagaaagagaaaccagagtgccatcctaagcataaatgttattaccttgttgattgtttagtattattttggaacaataagacatagtccttagcagcttagttgtacaatgcatcttttcactatcaccatttgtcctagtattcgtccatactgaacactttccacaacccaggcatttagcactcataatttcctagtgtgctgtaccatttttccagtgttcatcatttcattttttattaactgcccctttccatgatatcctcttaaaggtacagtctcaatcctgcttcacataaagcccctcccttctgttagaatactgtttcttatgtcctcgcaatgcttcttctggtatggatttcttgtatttcctgtggtagttctccatctgttgcttttctgatagtaaatttgtaggctggatataagcatactatattgaacgcagttgcacctttggaaataaatgggaattggttcgggattcctaactgagcagtcccatatgtgaggaaaatgacacatattaaataccaactaggtagtttgtgtacatgatcttatgtagtattggcaataatattctataggttgtggagtgcttccattttagagaggaaatccagctttgtaaagtgattgcattatccatttcgcctacttagtaaatatcatatttcaaattggaatccaagtttgaatgaagaatgcctccttgtatttaaatgtacacatttaaggggaagatatactttggtgggtgtagaaagcaatggtctctgctaactgacagggatgataaactcatgactagtattaaagtataggcacttcttgaaagccctacttcctttcccaaagtttgtattgctgttttcatctttccatgttagtgcgtattaaactttgtaaaagttacgactgatattgtactgataggaaatgtgttttggtaaaagttgactatacaggtaaaaacttgtaaattagcaaaaacaaaaagtggaattacactttcctttttgaaggcagcttggtgattgagaataggctaagagcattgctggcagagaatattaggcatcctcttccagtggatgtgtgaaagcttttgctacttagcatgtcaataatatgtcgactggaaagggttttacaaatatctgagcacatttgaaaaggtatataaaactagcattggattctcaatgcagggagtcctttcatcaccctgtgaggttggttaccagagatttgtgattgaggctgcaagaggctaaatcactttttgaaatgacaacataagtggcagaagagcatttaaatacattcttctctaacttcctgagagcatacaatccttcagatatgccaagtgagtaattttggtattgttcctgtaatatgtcctattccattaattatattatcaggcgtatttcaaaaactagtacaaagatggatttcagaactgttctatcagtaagcagagaagatatatattcacaattcttggtgacacatactaaatgaaaatgcattgtagctatttaaatcaccataagtttttcttttcagttatgttaaagattcacataggtataatggcttattttttcatgaggcaaagtagcttaaatgcagaatttaaagacgtgatcgacattatgacatgtcttaaatagtgttaatattctttgctcagttaatttaatcctttttaaggaagaagactgtatttttgactggcctttagttaaaaggaaattataaacgtcattctaaattaaatctgtgaatagtaaagtatttgttgatatgtgtaatatgaaggctgaatttctagatgtttagttggctttctttgtctagttgctaaccactacactgtttggtggttgcttgatttttatctggattgtagagcatataaactcaaataagactaggagatttctgttgacatgcagttttttcctagggaaatttactgcatactgcagtgggaatactatttcatatcagtgtcctagccctctcttacacacccattcactgcagacactgaatacaatattcagtacacacaagcttaaaagctagcaggttttaacattctagttgtaattctgtggtagttatgaaatatgaaaaataatgttttaagatttattttaaaacactttggtaaggaaaacatatttcctcttagcttgtcattaatctgggtttacatgtgggctggccccacttatcctggaggcagttaatcattaaacatttttagtggcaaaaacctctccttataaaaagatttttgtcttcctgtcataaatttttcatacttctttccagattttaaactagaaaatattgtaaatattatgggatagcattatgatttcctttcaaactgcagtggaagatgccttgttgtaatgtgtcctttatacacagaatattatttattagtcgataatttgtgtcttcagaaatatttaattactcatcactattcaaatatacgctggatacatttcaaattggtgaccgaattaaaataacattggtccttttagcccaacctaaatctaactactaggttgagtaaaatcaagctgttaataaattcaggataatagccaacttggtgggctttgcctttgatagttgggaagtccatgtattgctgaactactagttccaagtacatcagtcaggcatgtatgccaaacctcttcaaaacacattaccagatttattccttttattcaaccatcctgactgggaagaacagaaatggggaatgctccttagagccatcaaggatggattcttggcaggtcttaagctgatcagctgggatgatcttggtttgtcgaaaaaaaaatggaggaatggtttactgaagctgattatgtgttatagttcatcagggcattttgttaaacttgtgcagcagaatgtctgcgtttccccctatgtgatagaaacagcaaatggcaggctctcactcaagaatcagtagtgggtgtgttctcagaagccaagggaagtgtctcagcccttaattgtccttagggaagaagtttattgattctatccttgtctttagataagcacatcacagcatacattatccagactggtagtgccacaggctgcctggagccctaatggagaacatgtgtctgacttgttgtcatatatcaaagaaggacaactatctggcagtgcaccatggggtctatccaggactatgtctccaggaaggctccatgttccttcagtgagaggatatagtcattcaaggtgtttcacctgatctttcccaaaatgtcaggtgggatgccttgagccacctcaagttcctctattactgtacactgggttatgtcttctgtgcccctctgcttccatgaggactcattggaccatcattgtcttcaactggtgtcctccagtatacacatagctatgattgtcagggccactcaggccatggtgttgccagaatgaagcagctgaagttggcgctgtctcaggtggaacagacactacatgcaccaatgtgggagactggaaggctggaatgctgcaggaacccactcaggtggcagcttatggctagctttttggcatatataccaaacccataggaaagacaaacttgctagctacacacatgggagaaaccaaaatttcttcttgatgagatgactcacaattatcccatctttctcttttaaagccagtaaactagaaattattgcttatgtggaaagttgtgcctttagcattcatagtacggacctggatatggcaaggatgtttcttatatttcacctttgtgtttgtactttaattttatttgaaatgaactgtaaagtcaaccagaaatacactttatatttgagtatgggggattcctggtgctggtgaccagcatcagttaatgcatttaagccttgagttttcacagtagcactttatatattctcatttgagtagctttgagtagttatgaagttttcaatattaaccagtttagtttgacactaaagtcagtgtataagcatattcaattctgttaacattcctttagtttttcattttacacatgtaacaaagcaagcagtgatgaaatattcaaatcttatttatgttctgcatttaaaaatataggatcttcaatagtgcagatattttctaattatatatttagtgcttttcaatagtattttttaaaagtctaatatgtaaaatgtacacacacatacaaatgcacacacatgtctctggtagtttgactgagaattcacttattgtctcatatatttgaatgcttggctccccagtggaactgtttgagacggattaggaggtgaagctttgttggaggagatgtgtcactgggagtgagctttgacctttcaaaaatccactacaggcctagtgtcacactgtttgctgatcaggatgcaaatctctcagctactgcaccaacaccatgccagccagcatgctgccatgatccccaccctgatgataattaactaacactcttgacactgtgaacaagcccccaattaaatgctttcttttattataagagttgcccttgctcatggcgtctcctcacagcaacaaaacaataactaagacaacttaaccatattggcacctgtatttaaataccctgaaatctgtgtggaatcacaattgacttgatatagcaaacttgacttctgcaaaatagtacattttgctcttaagctggacagttcttgtgattgctaaaatgttcaggtccagtggaattataaaaatgctactaagccatcattgagagagaattttctatcgtagttgtagctcttatatcctttgtcttgtccttcctttggtgccgccctcctacctctatggttttctgatgcttcttttgtgtgtggaaaggtaatctatacagataagtcttacaggaggagccacatagttagttccaaataataaagaaaagtgcttatatggaaaaaaattagatttccatataggcccagaggagtagatacaatcaaggggtaattatatgagatacatttcatatcagtaaaagaattaagtaaatgattgctagtctactatgccttgattctcgactgactgccttaaacaacactgaatggagttaaagcaaggcactgaagaatagtaacaaaaatatgtgacctttggaaattgacagatctatgtcacatttttgactctattttatttaaatttcagttaaaatattgtattataatttcacacatgtttaccataaataataatcactctcatctcccacctctctactactccattttcccctttcctccccccagctctctttctaacattcatatttcatgatttttgttgagtgacccaccaagattaaccagggccacctatgtgactatggatgtggagctgtctatcagagactagtgggctcagcagaaggatacacagctaaagtctgtgttttcctcccttcccagaatctatctatagccattagttcagagttaaagggtagggaccgccccccttccaccttgatttattgttaataggcctggttttgtgagaatccagtgcagataactatagctgatgtaacacaaataataaaaatccattcagatattatggttcaagatgaagatcagagaagcaaagaagccagcttttacctccatctgaggctgaaagggctgatctggctccaggattcctcagaggcaaatgctcttcctgtctgttaactaaatctccacatgagaccctttgcttcttccttttatacctcctagtgttgggattaaaggcctgtgatcccaagtactgagatcaaaggcatgaactccattactcttcactcttgtgtagaccagggtggccttgaactcagaaggattcatctgcctatctcctgagtcctgggattaaaggtgtgtgccatcactgcctggctctgtagcttgctagtatggctgctgagattaaaggtgtgtattaccacttcctgcctctatagcttgtggctagctttgcattctgaaccttcaggcaagctttagtaagtcataaataatatattatcccaagatgatgttaattaataattacgatagctgtatgaagtctagggaatgatagttcttagtccatatctagatcttctaacacttaaacacttccaacttccttttccttaatgcttcctttgtctctacttcttaataattgtgtggctactagtgattcacttttgcctccctgtctctaatgttggtgacaatgcttatcttgcaggttgatataaaagtaaatacaatgtgcataaaactcctttacaaagtggttcacacatgtagttactcactgaatagcaggccctggcttttattttatgcactttatgagtaatcaaatacttaaagttaggtaagttgtgctattcttaaccatttatctcatggatattcttttgtattacttttagaaatatatggtttaaatgttttgcaaatgccacctttaccccttgcatctagtagatgacagattacaggagagtttggtttatataactctccaaggtacatagtgagacattgttaaaataaaacaataacaaaaacatgtggatgacttattgttaccctcctctctcatcatggtatggtatgaagttagtaacttaaggagagaaaacaggattgggcccttgttcttccacttctcagtcattttaaatgaaactggtacttaccatatggagatattatttgattttaatggttatgccagatgctattttgtcttcttccactaacctgagatgtataacttgaggctgtgatgcctgtatattggagggcatattccagacctttattttgacaatacctaacaatgtgcacattttatagcagaaaattgtaaaaagattgtgttgaatcaatggataccagctttgagctctttgacaatttgaggcattttgatccttttgaaagtgaattgaccatttactaaaaccagtcaacattaagcttttaaagtaattttcatgtctgcattactgataattcttttggggggaaggtagggaatagagaaagattatgataaatgcttttaccttagcctgcctttttaaagagagtcttaaagggcagagcctcttggttgagagacacttaaatgataaatgatagtgacaacatttgtttttcctcaccagagttttggggatcagagcaagtcagagagactggtatcctaaatcttagcttctttaagtgctaacaactgtcatttgttgttccctgaccatcaaatattttctggaatattatccatttataactatcacttcagataatggctgtttggttttgtataatgtacttttaaaggaattttgttctttttaaatttaaattagaaacaatcttattttacataacaatccccctgctccctctcactcccattttcctatgtcccctgtcaacccctgtcccacatccactcctcagggagggtgaagcctcccatggggaatcttcaaagcctgtcatatcatttgggtcagggcctaggccctcccccatgtatctaggctgagagaatatccctccatagggaatagattcccaaagcctgtttatgcactagggataaatactggttccactgccagaggccccatagactgcccaagcctcccaactgacacccatgttcagggggcttgtttcagtcccatgctgtttccccaactatcagacaggggttcatgaacttccacttgctcagatcagctgtttttgtgggtttgtccagcacggtcttgacccctttgctcatcactcctccctctctgaaactggattccatgagattggctcagtgtttagctgtgggtgtctgcttctgcttccatcagctactgagtgaaggctctagaatggcatttaaggtagtcatcaatctcattatagaggaaggcatttaaagtagcagttccactattgctaggatcttagttggtgtcatccttgtagatctctggatatttctgtagtggcacatttctctttaaacccataatggctccctctattaaggtatctcttttcttgctctcctactctattcttcccttgcctagattaatcttcctgattcctcttgttctcctcccctctcccttcctcctccctccctccccatcaacccatgctcccaatttgctcaggaaatcttgtccttttaaaggaattttaaaagatctttaattttttaaagcatgattgttattctcctaggtttctcacctgtaggggatttcctctgagatgcatattttatgtaatagagtgagcctacacttagtggtgctatcttattttcttcttcagtatttcctttaaacacgatgctttcccccctactctcatttatccactgtctctatttacttacctgttagtttttgaaagaagtacagatatttggtaaaaatttttgttaatatatggtgaagttaccacagcgttggaatacttttggattgaaagttaactactgccccaaactgtctgagtctgtactactttcacttagaacacacaattatccaagagaatacaataacatttctattgcttgatatttaagtattcttttagtgcccgggacacacatacaaatgcagaatatttctttacaaaatggagggatagctcagaaatcaagaatacttgctccccaaaaggtcctttggttccatcacccacatcaggtggctcacatcttcctgtaactccagatctaaggtatctgattccctctactggtcttcacaggcacttgcaatatctgcacatatccacacagaggtgtgattaaaacacatctatcaaataaccagaaaatctctttataaaataatgttatacatcatgaactcatatatgacattttctcattttctacttcagctcttccagtgaaataacacagaaaaaaactgtacctagggattttgtgttaatttcattattggagtttgtatttactaatttttaacaagattcttcttgtgtaataactaatatatccatctggatcaaatacttttaatgttttatattacattatattactattaaatgtattagtattatatattatatatagtattgttatgttgtataattagtatatatagtagtattataatgttacataatacacttccatcagtttgatcttctatcttagaaaaatgtgccatcatatttattaacagatacagtttacaaaagtttagttagataataataatagtagttacttttgatgctcatttactatgaaataaacattgttctaattgttttgcttaatttacttgtcagaacattccaaagaaggtgttttctctaaaccaaagaagggagaatttaagcaattttctccagattacatagctgcctaggtgatctcgtctaggtataatttctggaatccattccttaacttcatgtgaccgatccattaatcttactagaattgttttaagaagtgtttgtcttgtagttaagtgactttttgagtatatattcatgatcagattacagaaatgatgttgaatctattacttttaggggtttctcagagcttctatgaactttgagttgtctcatcttcttgacatgattgggaaacattttctttctatcaaaattgttccttgtacagctgtagggaactgggattctaagtgagctctgttgtgagaaaggtagagaggaaagttaacatacttgcctgagttgtttctcctaaagaatagaaattctgatggattaagtctagaagtaggttgggagagaatctccaaatgcctagagatctgactcctcaccattttcatttttttttctgccaacacatccaatatagtttcattgaatgtgctttacgtcatccctaaatcattcctgatacaagtactacatttggttcattatcctctagtgaattatgtgtttgataaattgacatttctgtaactgttcctggagagttttgactgcacaggagttccaatgcaaatggaagatgcagttttgccagtaacagatattaggttttttaaaaaaagcttgctttaattaattgttcacatcgaaaaacccatggatgaccagtgttgtcttgtgcaaaagataaagaggggtcaagttttttattaaagtacttgtaaagtctttacaccatgctgactgagcctagccaccggataggacccccaaaacaacacacagagacttgtagggtacaatgctgcaggccaatgatcaggatttcttatctgctagctcagtcttaattatcaaccataatcataagacttatcttatggaggacgccggtagtaagtgccctctcttggcggcggatcacgtggtgtctctagagcagagaagagagcaggaggaagagtagttactacatttcccaaaatcctctttgagtcctagtcctgcctaactctcttcttcattggccaacagtactttattcaacaaccaataaggatataaacatacacagaaagacattccccatcaagtactttttggattttttgtgtgtaacaagattttattaaagtactttgtctgttagcctttgtatttccagtaaggcatcctgaatacattcattttacttgaattattttagtttttatacttttaaggtttgagaaggtaagaatgacgatgaaacagtactgtaggtaatttgctgatggctcatgcatttatatttttcttacacttggaaggtttgtttatttttcaagacatggtttctctgtgtaacagcactggctgtcctggaacttgagttttagaccaggctgccctcaatctccgagagattcccatgtctctgcctcctgagtgctggtattaaaggtgggtgccaccttacctggttttggaacagtttttataagtaattgttataggaaaatctaaataggcgttattatagacacaaattaacttgttataagcttaaattgtaatattagagtatttattttatatattagagtattacataataacaagtcataatctatactcttgtccatcatcaagcttgattttaggtattttttttagtttttttcattttagacagtgttctattactgtgaaatgacagttgcttatagttttggatgtttagtccagtattgttatgttgagaagcatggcagcacacaggcagacatggtgctggataacaacctaagagttcttcgtctggatcttcaggcaggagagagagggagagagagatagagagagagagagagacagagagagacagagacagagagagagacagagacacagacagagagactgagactggcttgggtttttgaaactgaaagcccacccctgactgacatatttcctccaataaggccacacctactctaataatgccacatgtcctaaacctttcaaatagtgccacccctaagcattcaaatatatgagcttatggggccattcttattcaaaccaacacagttcataaacttagcaggcctataaggactatagagtttttctcccaattatcacattggaactattgttagagaatttgccatttcccattaatttattcatgtatattcattccaaaaatactttaccccattaacatccaagtcttactactctctattgtaggatttcactttccagaaataactgtaaaactttcttcagtattatgaacctactactactcagcctgtcatgaaacatttatttttgctatttctctaagtatgtatgccattgaggcttgtttaattgcaattaagaatatagcattttcttggttctttattttgaaagctcttctgctttgtgatgtttaataggataagtcattcacacatatgatacttcacatattctagatttaaatgtttagtgcttacttttgacaacttagtaaagatttctgttctagctccatagatttatttttgaagttgaaaaattgtgcttttaaaatgattatgagaaacttcagcttgcatagtggtatacaagaatgaatacgttacttgtgtcaccttatgtgatatatgaaaataataggcgaaacagtattgataaaattctgtttagccctatgctcttactcattttaatccacagctaagactttccactggtaatagatactttctcttcatcacaaattggagattctaataacattgcacaaaggataggtatagaaaccacaaccaacaacaaaaaacccaaatagcctcattcatcttttaaccagttaaaggaaatgaggtaaaatgtacaaaatgcataaaaacacacaaaaacccctcaaaccttatttgccttgtctagccaagcttgttgtgttatggattttatgtggcaaacttgaaatggaatgtttttagttaaaaaaacaaaaagatgaaagtctgaaacaaccaactggcaggcttagaatacaatcatgtttttagcctacctaggtaaaaaggaggtatgaagtgactacttaatagcagcttttgtttctttaaatctgggtttcttaactctgaaattatgaacctcatttatgttttagtctgtattttaaatttcttccatgtgtttttattagtctttctcgccactgtttaagatagctttctcagataattagaatttttattttttcctcagcttttctctgaaatgctggtagagcatgacttattttctcatttaatcagttagtgaaactataatgtaattaaactcatgatggaacatgttttatccaaatttgaactgatagctaaggctctaactttggctttaaaacctcaaaatatttccattttaatattcttcaaattaggcttgtgtcatgttttgtaacatatgacaacaagggctatgtggctttctctgctataaataaatatgttgcatattgaaacagaataaattttcgtatattcatttaccaagtatgtattttattgaatattggatgaacagactgctcaaaataagaatggttagtctttgttctcaggatgatagggagtcagatataaaccaatattcattttaattatcctaagtgcttaaaggagacatccaggagattatagagaactcatttgggaggacagggaaggcttccctgaggaagtgatatttaagctgaatctttaatgatgagtaaagattagacaagtaaagaaagtacaaaaattttttcagtgtgggcaaattagagcttaatgttttaaaaatatatgtgaagaatctgagaagggagataaaaatcagagctaaggatttaaattgttcaaacattacaagctttagaacaccatggaaatacttgaaatacgacaattttagaacatgtctacaaattaaccttaatctagatttttttaaatggtttggaaataacacacagatgcagactgtctgcaactggtatgttgggaaagaaacacaacaagcaaatgggcagactgatgaaaaacaaatatagaacaaaagcaaatccattaacatatttttgtgtggatggtagggaagaagagttcaaatagggaaagatatttggaatcattttgcctatttcaaaaagtcctttcatgagatacctactcccacttgtcctttaataagccactagcagagactcagtgtctaatatgttgatcccactcattcagaattcagtgtttctttcataatattcacctaatatgcaccaaagtacaatgtgtgtttcagaacatttaaaaatagaattcaagatgtttccttttactctagtgcttatttaactatgatgacatgtctttaaagtttatggtagtgtttaagtagtagagtcttcactagttggatttatatacttcagaataattaattatttattcttcttaatgttaagtgaaagacaagaacgtgttaagatgcagagaggggaatgcataataagctttctgcttttccaaaactgcctgtagctgctactcattctttctgctagtatgcatctctctggtgtgcagcattggggcaatagccatgagaaacaaaaacaagagtctttgtatttgaattttcaatatttccagtgaaatgaaaggtatgcgcattgtcacgagacaatgaactggaagctgcacatatccttttgaattcaggattgttttggtttggttttgtttttaaattaaggcgagattgaagagacttgccttgctatttcatttcggatgcattgtacatgagtataatgcgaatgctctttgagagcatatgctatagaacttgttgaaacttctgcaagttcttttacatcatttacagctgtaaattatttcatgcttacagcaaggaggtgaacactccagaataataatcagctacctatttacaagaatgttgagaagctccaagtactgcttgcacaaaataatagactagtttcattgtagtagtgaaagttccaaagcaatttctagacatattatctattgagacagttaaaatacatttatatttcatttctaaaatatttcccactatgtatgtaagatgtctcaggaaaattttaatgtatttcattgataccaaaaatactaatcttaaatacacacacacacacacacacacacacacacacacacacacacacacacacacacaatctaccgagtacatgtagctcatatgtgcatgtgttcaaggatgaccacttgggattggacaaactatgtagggactagtgcctggcagagacacctatagctattgagatttattaccaaaatgaaacatacaactgcagtgtcactgatacttcaatttctgtttccgtatgaaggttaattctaacaaccaagaaaaaaaaaaaaacatttcagcaggaatagaagctcaattttttttctaatttttttcagctgaaggtgataattctgaaagttaggaggataaaatcaatagacagctgtatacctacatgttcattaatgaaatgagaaggtaccgatggcatttctttccaacagtaatgtgttgcagaacagtgaaaagagcacattaataatgttagcaagatacaaattgatcagaggaaataagtagagatttataaatctatatgaatttcatgcattatgaaagctgaagaaatacactgatgaacagagtacaattttagaagagatgagatagactatagatatttacaatttctctaaatttttccannnnnnnnnnnnnntatttcaattattgaatttaacaaaattttcttatatatgaaaagttataacatacaagaatatggaatgccattgagagaaccaaggttaacatttttaatgaagaaataataaaatgctaataaaataatacatgaaaactaatacacaaatatatacacatatactaaagagtgtatacattcatgtaaaaatgaaagtaaaaagtctagtagattaattttaaatatataattacagcataaactatgctttttgttaaggacataaaataatgcaaaatagataagcattgcaatcctccctctttgtctgatgattttacatggtaaaatatttccaaaatttagcatctcttctctcagtggttaggattaaagggtttgaaatctttattgtttgaagaagtcaacagattgtacctgattttaattgaaaaacatgtcttcttttccttccttccttccttccttccttccttccttccttcctttctttctttcatttctttctatctttctttctttttcccaccattctttttttcttttctatattttgctgtactatcttgtgtcttatgttgttactcattttattctttcacttgttacctgttttattttcaccttatacccacacatgtatgtaagtttctggaattctgtgtatcctcaagtataaaaatttggcttttttgttgtttgcttgttttgttttcttttgaaactgagtctccctgtttaaccctggctgaacttgaactcactgtgtagaccgggctgtcctgaagccaacaaagatcgcttgcctctccctcccaagtaacataaataaatgtgtacaacactatgcccttctatgtatcaactattttaatctacacaattaattcttatgtaacttatattgaaggcagttagtacaaaatgtagacttttttacatgtggaatctctctctctctctctctctctctctctctctctctctctctctctctctgtgtgtgtgtgtgtgtgtgtaggtatatttctctgtgataatttaccatattttgttactactaataacaataaatgtgctatttttccaaactaaaaagttgctgtgtaagttctgaacctttgtgtttttgacagctaactcactcctttcaagaataagtgagcttcaagtgccttttaggataatgaaaagtaccaaagatatcagagttaaaagtctaatggataggacactggattagaaattgaatgccccaggttccattctcagcttcctatgtttctgtgtattattgcaaaatctgattaaagaatttgttaaatatgtaaaatggggctaatacatcttatattactggaaagctactgggaataatgagaatttttaaagataatacatttttgttttttaagacagttcttatataagggacatgatctaaattctatctgaaatttgaatgttagcaaatattataatgccataacttttattccatagtttaataataacccgatacatttgttgccttttttgtgcaaatacatcaaagacctatatttaagttatgaactattagcttctgttttagtcctcttactttacaagtattcaatttcttacatattatattatattttgagaaggaccagcaggtatttaaaaaattaactatgtgttaccatggcatttaaaaataatactaaagtgtttgcctttatgatttgctctatttccattggaaaataggggcagtggagcaatggcaaaaataaattaaccttattacttgaattaattgtaaaaaaaaaacttcacaaaatatcggcaagttctcacttttttatctatgatgattaactttattgggaaaatgtcattctcaacaggggtgatagtttgtgtttgttatcccagcgcttgaggaactgagaaaggaagatttgtgagttgtaggtcagcatggtatatagaaggagccctggtatcaaaataccaaagccaaggtaatgaacaaatatacaaatgacgggcaaataatgttcttagcctcttgaaaattatgatgtgtgtccttcttatcttcatttacccagcatttagctcatagatgatccttaggaatatttatttggcaaataacttcactcgctgagataaaaaaataaaagcaatacataagtgctatttgctgccatgaaaatgaatgtgtcataagagttgagagcttctttgaaatcattataaatgaatcatctcttatatgtacaaggtattttcataaggattcaggacatttactgttgtttactcctcaaattttggcatagaagccgtattttagtccgtattcagtacattagattggttctcttttgtggaccaagacttgtgctttgcataaattacacaagtagtaattttctggagaaagaatagtatttcaccttttataatttgctttaatctcacatactgtccctttgttttttgttaaattatgtcaatttttaacattttatgaaatagtgtttccagtgaatggtttgcaatgttttagattagttgaaaaaacttgttggcatatttagcagtaatgatgcatagcattttgtttgaattgctacaaattagctggaagatgtgcatctgtaaatttagtaattttaaaatacatctcaaaaatggatctccttattgaaatctttatgtttcagtaaatgagcattctaatgggaacaatagtctaccccggagaagagcacaccaattgattgtccaataccaaatagtcatacctgaaaacatgtgtgtgtgtgtgtgtgtgtgtgtgtgtgtgtgtgtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacacacacacacacacacacacacacacacacacacacacagtttaagggaaagatgccatgaatttgaaagaaggctggttagaaagaaggctggttagaaatgtcaggatagtgcattaacctactgtgcttcagatgttctactattttttcttgtcttgttatatttaaagtatatggtaatggcagcagaacagtttaactgatgtcagatttgggcagtatatatttttttacattttctatagtgtaaacatccacttaaaatataagatgcatagcaaatatttgataagtttgaacttctatcactttctgaagtaatttataaagagtttatatgtataaattattgaagatacttaacttccatatctttacatagtagaaaaagtcttttaagaatgtatatgcatttgttgtgttttagattaccttaattttgtctttgaaaaagacacactaaggcataattaatagaatgtgacctatgaaatattagttctattattattttgaggaaatgagactgtgttgtcttatgttcagatccacagtagacatgtttagatgtaacaatgctaaaagcagaaagacatggttggtaatctataaaactaattccattatattggcaatgctacactgctgtttatgttgacatatttgtcttactctaacatctataccatttatgggtgagaacattataaaaactacaaagcttttatgcttaattactagttcagtattcttactaggtcattctttcaagtcaggttgagatttgaggcaagcaggtttttgtgatactcattgagtactagttgagaagtttaattggttctcatgcaatagggatgaattatttatctcagaagcttgaagaacttctaaattccttacttctctagggaataaatacaaatgtttgaatgtgttaagtaaattcagtttactgaaatgaagcctaaagacccattttctacatattcttaaaatttacatatgctaacctaaataagtctgcttcttttaaacactagtgagaacattatgccactattaatgcccatttatttaatttaacctgggcatttagggaccagttgattgtattctgagttagtcccacattttacagtgtagtaatgttttgagagatcagctcacatacagagaaaactgagtagtcagttgcacccagggaaatgaaagtgccctcctctacacatgtattcactattgcctactcatgaaataccttttgctctgtctttacccccgttgtttctcaatgtatgtcctacttacagattcttgctttcagatttattcatttatttaatttagacaaaagggttctttttattggatatatttgtgtgtttgcctgcatttatgtatgtgcactacatgaatgcctggttcccatggaaggcagaggaaggcattggatcccttggaactagagttagaactgttatgtgacttccaagaactgaagccaggtctctgaaatgacagcaaatgctcttaaacccatgaacgaactatctatctgtctgtctgtctgtctgtctgtctgtctgtctatctatctatctatctatctatctatctatctatctatctagttttgaggcacaatctcattatgtaaacctaggtggccttgacatgactatgtagaccactgtaacttcaaattcatagagatctgtctgcctctgcctcctgagtgcaggtatcaaaggaatgtgtctccatgcttgtcctcaagttcatttgtttttttttacatcagcatataaaaatgttgtgtattcatagtgtacattatgatgtcctgcaacacatgtgattaaatgtagctaatttacaaatgcattaactcacagttattgtagtaaaaacacagatctcctagaatttctcaaagatatattctaaactgtagttgaccatgtcctacagtagatttcttgaacctactccccctgtctctctgtagacatgtattatatttaattaatatctctccaatccctcactcccaagtaccttagcctgtggtaactcacatcctactctcaatctctatcaaatagctttatattatatacgtaaaggagatcatgcaaattttgtctctctgtgcatgcataatcattttctcttccacattactgcaatttatagaatttcctcctttcatatctcaatgtaacattctattgtgtgtatgaaaattttaaagaatttgatccataatgaatagtttgcctctttaacctggttataaagtgaataatgctgtagtaagtatatgagtacagatatatcattggcatatggatagccattggagatatggactgctgaatcatatgacagtcctatttttacttttttgtgctcttccatactaattttcataattgatgtacaattatattctgaccacagtgtacattggtccctttctttacacttttaacacttaatatttttgataatctctgtgcatacagtgccatataggatgaccccagtggtgccacctgtgtttcctgtgtcatctgcagttaaattttaatgagtacaggcaacatgtggtgatgtcatttgttgtttattttggtacaaatactttttcatactaaggttatttcatcaggattcaataatgaatatttcactttcctggaaaagtattttctttgatacagatataaaaacagagattaggtggctggatttggttagaaggtggttagccaagtaattcagttaatgcttaatgctgtcatcttaagaaaaggaactttggagttttaaaattaccttacccacagcaggaaccattaaaatatgttcaagaattctagtttgagagttattagcccagagttccagtttcattgatgtactagcaaatctccaaacatgctgtgtttgagtttttgtatctctgtgattaacttctgaccaaaatagcttagtctgccttacatgaatagcatttattagtctttgaacttcatccctcaaatagattcattgattctttaaggtctcatcctctaccacatactatgataatctttctgctcattacatagcagaatgtgagctctgttatgacatcattgtgtctcagcttcttactgtttgccatacctgagaatatactccatgcaagtggtaatattctaatataagaaggactgactcccaatgccccatagcagatactttatgttcatgttgttgtttaatgaacacattggaaacctgcgtttaatgcaccagtagagagtaaggtaatcaactcaacttatttcacaaaaaaaaaacaaaattcctgttctaatttacatgctatgaatcacacattcaaattagctgggcctttgagattgtgtggcccagtgtgcttaaaactttattttatttagcatgagacttgctttgctggtagaaatcttcagcagaatataaatatgtaaatgatctcattattaggggaacaaaagacagactttcccagttagccctctctttttcacattccctcctcagccagtcaaggattcctgtggattctcaaaatatacttctaatctcttacctgtgatacaggtccattcctgaatatttcaggaagattagaatcctgcctctacttcaaccatatagttgatcagaagctgataatatttatgccaatgataatgtttcataagttaactgtttgggcattcatgaaaccatgaaattaacgacaaaataacatgtcatgtaagtatatactaattcaatgattactgtatataagtgtcctggttagttttttattgtcgacttgaaacaaccatagtcagctggggagagggaaagccagttgaagatttgcctggatcagattcatgtttgaccaaacctgtgagagtttgtcttgatagattgatgttggggaggtaacacaatcaccactcaggtgggtctgtgctatacaagaatgctagctgagcataactagagaaaaaggcagataacagtgatcctctgtggtttctgggtaaagatcctgccttgatttcctgcccttgcttccctctatgatggagcatgatcagactgtcataagctaaaaataaatcttttcattccaaagttgcgtttggttaggttggttgttctatcacagcaacagaaaagccaactggaacaaccagataattcttctttaccaagattattatattactctaacaagcctacagatagacaccataatatttttgttttgtagaacaggaacctaaggtccaggattaaaatgacaaacggaccagtttcacatggctaataagggtaaagtatagtgaggaaatgtttgttcccttccctttggtatagtacatcattgtaaataatttagcccccccccaagattgtcagatgcatttttaagcaatattttgcctagttgctaggctcaaatgaagtggtgtatttctataggaaggttagtgaaagctctttgtgctataagcatgtaaggtaccattgatgactaagtccttcaatctcaattagtatgaaaggcatgcatatgtttatttttcatgacaatcaatcagttctttcagttctcatttactcatcctttacacgctttgttgatactttacttcctgtcagcagttacacaaggaactgagtagtattcagtgcaatcattttgacagcacttactcaaatgcttggaaagttacaggttggaaataatgggatcacttcttgtctcatggaagacatttttctttatttcctttccaatttatagcttcattacctacttaaaatgtaatttttatgtaggctgcaggaaacatttataatcaacaacaacatttattaaacttgttttgttacattgtttgaagttaatattgtagttggagatgtaaaatgataaaacatatagggaaaatattaaacttctatttcttaataggatcgcctctatataataaattttggtaaagctttcacatccctatcaaagtctatcatgaagggagatgacggcaggaacctgtgggaaggaactgaagcagagagcatagagggattccaatttactggcttactccccatggctgctctacttgctttctagtaccatctgttcaggagatgtactacttcaagtcaactaggtcctaccacatcaatcaagaaaatgaccacagacatgcctacaggacagtctgatagaagggtcccttacatgaggttctctcttctcaggtgactacagattatatcatgttgaaaaaatttagccaatacaagcaatagcagtattgccatttttcaggataatattgccctctctaaaggtggacccacggacagtaattgctatctgtgtgcaaaccatggctgaaagagctatgtacaatcaatggttccagccagtgttcacagcatgttatgtttccaactaagaattctgtaggcttttctcaaattaaaagtcaattcgtttttacattaaaaactaaataaaaggtatgggatggatagtgcattagttggcagggcaggcgaggaggggagggagagggacctgggattgacatgtaaaataattttctttctaataataaaaaaaaagattggtccaagtaactaaacttattagtttgtcattttcactgcagacttagaacattctttttaaaatatttcttgtctagtattgatattaaaagtttattttagagtaaagggggatgttaccaaaagtacattttagttttctgtgtactgacttaggataatataagcatagtcatacggacaagtttctacattctaatgattttcaaattaaggaatggcttcaaattaggaaacctttttattcacctagctttggaatagcatgttgtactctaattactaactttgtctgcattactttttaaagatcaaatgggcacagtggtaattttcattaatctcatacagagcagctaattaaaatttcaattattatccatctattatctagttgttgcctttgttcagtatcagatccggatgttaataataagccgttcttgtattacagctctattaagtacagtgagatttagtttaatctatcacactgttttgtttcagggttatttctttaatactatgttgtgccatattgattatgctgaagatacacactttgacatttttcaaatagaaatttcagacttatattcctgttgcttcaattttttattcaacattggggaaagtggcatagaacggataaatgaatcattggaagttcaaaatatttataatttagttctgaaacctcactaattatgccgttacctattccccagaatctacctgttttaatgtgtagtcttggctgtcttagaacttactatgtaaaccaggctggccttgaactcagagatccacatgcctctgcttcccaagggctggtatgggaggtgcatcacaatactccgctgacttctttattcctataatgagaatgttaaaagatttgattttgggaggcagaggtaggcagatctctgtgagttcaaggccagcctagtctcctgagcaagtgccagtataggctccaaagctatacagagaaaccctgtctcaaaaaaccaaaaaaatattattttctgtggtacatataactgaatataaatgttaactgtcaactacaaaattaataagatgatctaacaatgtttatattttgaattgagggaaacagttagcataaatcctaatacttggaatataagtttaaataaccctgtcaataatactttttgctactcacatcaggtttcttttcagtctgtgaacaccagctagtataattctcttttaaagggctgaggagaatgtatcctacacaatagtcttcccactcaggtctttgaagaattgttggtctgggaatttaacatggaggtagagtattgaaacaaaagagtgaggtggcatagcactcacacaaagtaaaatattgatataatctttattcttgtaattaaaattcctttaattttttaaattggtattcaaagcattagattttaatgttgcttaggagaaaagattattgaaacatactttgtttgaaaaatgtcataatgttattaatatagtctatgttttacttgcaagatttaaaaaaaaaacccttgacacctctttaaaatgacatgttctatttgtttgatagggtggcctgaaaaacagcaagcatgaatgcaccctgtcttcacaagaatatgttcatgaattgaaatcaggtatctcagatgagaaacttctcaactgtctggaatctctgagggtttccttaaccagcaatcctgtcaggtaggcagttcttatcatttttataggattcatacattttgtattgtatatagatatttcgtataatcagatatgttactttaacctcatgatttttctgttcagaagtgtattatcatctaatagaagagcattgtctgattatcaagttctaaatgtttaaaaacatctgtttagctattttgatctttactcatgtatgattttaaaatataggtaattgtttaatagttatttcctttttgagaaggagttaaatctagaagctaaatatttacatttgcatattagtctatttgtttaccaagaaaattgttatatatttgcgaaacacattaattacattggtttaaaattttattccttttacacttgtgattatacgtatgtatataatttcatattatatttaaattttacatagaccacgttacacacaaacatacacacacatttttgtaactttgagatagctcaaactacttttaaacaaataaagaaatggagactattaattaattccttactattttatacattcattaaactatcttacagatgtttataaagaggcaagtttttgatagcaatgggtttgaataataattctttattgacaataacaggctttaaaattagtaatatcccaaataatgtcttatgaaaaaaatagatttcaatgtaatattgaatcattctgtgatctacatgctaaattatcaccgttttgagttcagaatttactaaaatgagtatataaagacaatgtaattttattagtgtttcccttatatttttcagactgatatctagttcataaagcactgaaaataatttaaatctcagtcatttaggtggaatcaggtataaattcgatatatttgttatttagagtcatatttttgataaaatttgaaagttataatttcataataaagacagtgttaagatgtgacttgctttaggttagaagcattttttagttgttgctatcttgctatttctaaaatggcatgcttttaagatttagtgatctcacgaaaagatttgagatctctattatttttttattttgtaccatctcaaatttgtaggccaggccagcctggaactaacaacatctttcaggctgtgtttgaatgttaagtaacccttctgctgtggcctcctaactgctaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacatgcaaaggagggctttgtaatctcgcgagaatgttgggtcctcatctggtagctgattggctgttcagtaaggtcttgaggcgttggcattctgcaatagctctagtccgaggttggaggtgccatcttgctgagattcgagagaccgtcgacaagcgagtttctgtgcagcctgtgagcgaacacctcttgctgtcgagccatcaaatcctgccaagacttcaaaagatgatgagtaagagtgggtttgggagtaatgatagctttgttgatgatgatggggctaacagggcaagcggcagtgatgagcaagctggaggtcaggacctgggtcttcccatgaccaccttgaccaggcctggcattcacagcattgtgccttgctgcataagccagttgcttactgctgttgaggttgacaacgtgtttaagatcaggggctttgcacttcaccgggtctctatcgtggggatgatcatggaggccaagaaagcttcgcggtacatgatgtacaagattgatgacatgaccgcaaaggccatcgaggccaggcagcccctgtcgcgcgagagggtcaggcaatgtgtgattcccctgccagttggcgtgtatgccaaagtgcttggtgtcctccagtcctcggagggaaccagacggcttggggttctaagcatccgtgtcctggaagatatgaatgagctgtccacacacaccttggaggtcgtcaatgcccacatgatgctggatcaaagtcgtgaaggtgtgtccacaggaaggcacctcttggaagaagccccagcaggagcagccgccgccagggttgctaaggcagctagtcttaatttcatccatttggaggtgctgcgtctgattcaagaatgtcctcaccaggaagggaaggctattagtgagctgcgaagagacctccatgcacttaccgatgaagctgtcactcaagctatcaggcatctgatttccacacaacgcatctctgccacctcggatagtgagtaccttaaaatttcaggctgaggcaatgaaaggattttgcggtttctgaagatgtttttgttctactgttcagacttttaggaaataccatttgtttcgaatgacaacaatgaaatacaaaaaacaaaaaacaaaacaaaaagaaataaaacaacaacaaaaaaactctccccaaattgcaaaagcagatgaaactgaccgaagttctcagcgccacctgttagcaatgtgctatttctaactccattgaacttgttggttttctgaagagatttgaagtgttagacccaataactggactcagtacagtttctttccaaaattattcccttggatggaattataatggaaaaaatgtgtccaaattagaattatattccctgtgttaattaatcttagctatgctaatttttcctaaatatattacaagaaatacagctttactggaaattgttatgatttcaaatattaggtcaattgtttgagtaatttgatttgattaacattgatttatttacttaaaacacaatatttgactacttatttaatcaattcactctttttttgagtcatcttcaaataattacttttaacatgtgatttcagtggttttgctttttctattaaattagtttacttttcttgtattgtatgtgggtgccagactatgtttttctcatggtggtgcaataccaacactgctgcgatggtctactctagggtaaaacaggttgttttgtttagagataagctttataacagttctagaaacagaagacttaatgagttgtaacagaaattaactaaattgttccattaaagctttgcaaagaaattttaagtttcctgtgtgatttttccccaaatttattagaaaatgttgtaagtttaatgtttttaagtgttataagcttctattatgaagtataaatttttgttttatttttaataccaatcattatatcttactagtactaactcatttttgagttggttatattaaatatgagaggcctttaagtcactgatcattaagccctccattatgcatacaataaaatggtgtatttcaaattacttgtttggttaaattacaggaaagaacaatatttttctagtaatagatgggtttgcctatgtgtgttcagataggtagaaaagaatattgatcctcttcattcattaaaaggtgacaaaaacctataacatagttttgctatttagcagtcagtaatctgttttcaggaaaatagtcagaaagtgatggcctttcatgatcagtccttaaaataattactgaaaaatcttgcagaagatcttgtgattcagtgtttactctcctcagaagcacataaaatataaatgctatttaaaatttttatttttttaacgttttaaaagatatttattttattcacgtgagtgttttacctggatgggtgtttgtgtatctcgtgcatgcctggtgcccttggagatcagaagagggcatcatatatcctgactggagtggcagatgtttgtgaaccactgtgtgggtgctggaaactgaacttggactctctgcaagaacagtgttcttaactgctgcaacatctctccagatcctataagtggtattttttaaataatattttgttctttgataaatctagctaattaattttagtcatacatgaaagaaccctgaaattgtcacaagacaccccaagaccaagttctcaggacaaaagagattaatttgactcagagggataaaaaaacagcaaagtagagggaatgtggagaagagtaaaaggcaaaacctgttggtgacatttaaacattctgtgccttcaagagcccttcaatattcctcccctatctctttctagatactcccgaaattaaaggaaataaaaaggaaaggacatggctgctcctaggtatggtggaggagaaagttcattgtagagatgtaggagaggataggcagaggcagggatggctgggaaagtccagagtggacaagaaccagactgggctgggctacttgggggaaggggtgtgggggcagaaaccatgtgcagcagccatgaggccaaaggtataaaggactggtaatcaaaatgtcttgattatgcagggcagagcctctgggggaaggacagtctgttccctaggctggaaagtttagggaaggggatggacatgccagccataacctggtaggaactgagggatactgggagagcctggtggccaggttggcttctatatgtaaataggtacctcagtcatttgttccagttttgaaacgtaacacccctaccttttgttgatactaaagggggccataatcatttgtgcctagttcctgttgacactggggcattgttgttgaggacccaaaaagctggaatgctggccaagtctgggaagctgtttcacttctctggactctgggggacttctggggttaggaaagtgcaagcatcatttagagcactttgccatctttggttggaaatcttctggaacagatatattaggggcagaaggtagagttaagtttagagggaatttttttccttaggtgtacaattgatatttcttggcccatggtcctcttagctgggggaggggaatcccaaggacaggggaaggggaagagatctcacccacagaaataggcaggtggggaaacagaactccattgattaatgttaaaattctgaattcctgaaacttaatattgcagtagcatagcaagggaaagaaatctaaagcatttttcactttttaagtatttaaatcaccttaaaaaaatttttttttctgagtctggtaacaaggtaaactgtgcctagacctagtagtagctctaggggagtaaggcctgaagcttgatttttacacatgaagagaactgaaaaggcagatgaagccttggttgctgctgttaaactcacaaggctgatactagcattgtcattaacactatttgagatctgagaaggaagaatttcacctaataggaagtacagaccaagcagcttctgaatctattaaaaatgacagagactagtccattacccagatggccatcccaggctcctgtgtgtaatgataaatctttttgctaacccgcccgagtcctgctgccatgtgggtagccaaaataacacacagactagtattaggtacaatgctgctggccaatgcctaagatttctcatatgctaactcagtattaattatcaaccataactactaatctttatattttataaggcttatggaggatgccgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtgggatgggctctcaaagtcccttcttataccagggaaaaatactaatccactaccaggggccccctagagtgcagaggccacctgattgacatccgtgttcaggggtctggatcagttctgtactgtcctcccatacagcagtctggggtccatgtgctcccctttgttcaggccagctgattctttgggtttcaccagcctggtaccgaccccttcaattttcattcctccctctctgcaactaagttccagcgtacagttcagtgaatatctttggatgtctgcctctgcttccatcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtcatccttgtaagtctctggaaatctccctagtgccagatctctccttggacctataatggctccctgtaacatggtatctctcatcctgctctcctctattcttcccccaactcaatatttctgctcctcgatttcctcctctcctctcttcttctcctcctctcattctggcagctctgtctcctctaccctcatgctctcaattagctcaggagatcctgccccttcccattctctggggtccatgcgtttttcccttagagtccttcatgtttcctagtttctttggtgaagagattgtaggctggtaatcctttgctctatgtctaaaattcatatgtgagtgagtatgttacgataaatctttccgccaaaagtcgcctgagccccactgccatgtgtgagctttacgccagctgccctcccgagttaggcccaaatgaatacacagaaacttgtattaggttcaatgctgcttggccaatgactaggattgttatctgttagttcagtcttaactatcataaacctatatattttataaaacttatcttatcggacgcctaattggcatccctccttgtcagtggatcacatcatgccactggaacaggagcggaggggaaaagagagcccttcctgtttctccttcgcttaaatatgagtctccttgccatgtcacttcctgcctgtatcagcacttctctactacatttcccagaatcctctttgactcctagtcctgcctaacttgtcatttcattggccaaacagtattttatttaacaatcaataagataaacatacnnnnnnnnnntccccatcatgagtacataccatgtttgtctttttgtgactgggttacctcactcagaatggtttcttctagttccatccatttgcctgccaatttaaagatcccattgcttttttctgctgagtagttctccattgtataaatgtatcacattttctctatccattcttcagttgaggggcttccaggttctggctattacaaaaaatgctgctatgaacatggttgaatgtatgtgcttgttgtatggacatgcattatttgggtaaatgcccaagagaagaatttctggatctcgaggtagactgattcacatttttctgagcaactgccatactgatttccaaagtggtcttcttgtacttccattggcatgtctttctttaggttggtaaagttttcttctataattttgttgaatatgttttctgtacctttgagctgtatttcttcaccttcttctatacctattattcttaggtttggtcttttcacagtgtcgcgtatttcctggatattttgtgttagggatttgttggacttgaggttttctttgattgatgaatgtatatcctctagcgagtcttcacctttctatttccaggatccccttgttctgtgttttctttattgtgtctatttcagctttcatgccttgaactcttttgactgcttccttcatttgtttggttgttttttcttggctttctttagattctttaagagatttatttacttcttgaattttttggtttggcttttccttcatttcatgtaatttttgcttgtttttttttttctatttctttaagggattttctcgtttactctttatagatctctatcatcttcctaagataatttttgatgtccatctcttcctcatcctctgtggtgggtttttcagatctagctggtgtggagtccctagattctggtggtgtcatattggtttttctgtttttgagtgtgtttttactctgtcttttttctatcccttcttccagtgagtgcaggtggggtctctctctctcaggtggttggcagaaggctcagcctctggcagtcagcgggatggctgagggtggtgggtggtgtggacaacggtggggtgtgtcaggactcagcctgggccttcccggtcaggtcaggtccactcttctatgagtggactcaggcagaaggaagcagggattgatgggggaggttggggagcagagcagcgcccagactcacctgagatttgggcacctgcagcaggacagagggcaaagtgtagacaggggtgaggtgtgtccagactctgggtgggccttgctgtttgggaaggtcctctcttgtctggggtagggttcaggcagaagtgagcaggagtttatgggggaggttgctgggggcagaacagtgcccagactcacctgaggctccagtgcctgcctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgggtgcctgctgcaggacagagcagagtgtcttagggtttctattgctgtgaagagatatcatgaccacgaaaacccttataaaggaaaacatttagttggggtgaattactgttcagaggtttagtccattatcatcatggcaggacatggtggcatgcaggcagacatagtgctggataaggggatgaaatccctacatcttgatacataggcaactgggagtgatctgaattaggagtagcttataaataggagatctcaatgccctctcccaacacccatactccaagaaggtcacagctactcaaataaaaccatacctcctaagaagctcactccctgtgaggttatgggagccaattacatccaaactaccacatctaagaatagcaagaatgttgagaagacaggtccttagccattctaaggtagtaacagaacccagttaggtttcacaagcctctcttaactcagttacaacaaatttatgacaatcatcctaaacttcaaatattgacattgactcttcaattatcaaattatttgtgttaactacatgatctttgtattgcccagttcagatttctaatagagcatctctggtagatggaaacaaatatattccaggtgatgtctgagaaatgtagctggaacctttatgttttaactctcccatattggagaactcagtataaagatttttatggccatagtgagttataagtgagatagtagttgaaaaattcacaccttggaattctttgtcttcagatagatactatgtccatttcttgatcttcatcagttctgtatctgacatcctagggcagcatctgcatttctcttaagtaaataaactcccatgaagaaatggaaaggatgacacttaacatagaatgccatttgaaatgaatgaattattaaaagattaaggaaaggacggtgtcaaaagtaaatccaagtctatatcaaagattggaagggaggcagaaacaaaagtctcctatttatcaccacatatttcaattttccttcctaaaattgtgaataattttgtcacggatgtattttatgtttcatatcacagtcgaaatatagttcctgatggcactcttacgttagtggtatttgtgtttttatcacaagactaaataagttctgaaggtacaggataatgtcttcctccatttagaacccacagtaaatagtatcattgatttttaaataaagtgtgtagaagtgctgtaggaaatagttatttaatgttactaacactttgtacattaaagaagattcattttattcctttgaagtgtcagcatccaccccatagtatacaatggaatatacttcctatttccaccaggtaaaacccactgtaaaccatggaactttgctctctagatattttcagctttaaaagccctctcagaaagtaacaaataagcaaacaaaccaacacagcaaacaacagattaatcttcctactggatagaaacaaatatgtaaataaaatcaatgaagcaacagcaaaaaggaagccagcattagaagaaaccaagaatcataataaagtatatgaattaagttacacagataaaacaaacactacaagcaaagacaaatcactttgagtacagtgtattgtgcaacagttaaatagtccttgaaattagggatcactgagaatcatcctgttaatctcatatgatttgtgcaacaatcaccacaaagacagtagtttaaaacattaaaaatttagactcttaaagttaaagaagacagaagtttcactgagcttcctcccagagcttagaggaagcatttttgcctattctggctccttggtttccctggctcttggcaggttgagtccagcctttgctttttctttccatggattatttattcttggaccacttgtctgtcttttataaggacatgacttatggcccactctgatccactagaaatgtcattgtgatctttattttatatctagaaacatcctattttcaagtaaagtcatattctgaagttctgagtggataatgttcaatccaccattattttgcaaagggacattagctttaaatcaattaaaatgacaaaacaaggctcagttattttcaagaaatggcattaactagctcagaaaagttagaaaatataaaatttgtcactttagcctccttagtgaaattgtattttgctagattttttcttcttataaaaaagtattttttgtggttaccaattatgagggctatatcttatatgatggagttactctggagtatgcctgagatttggtttctgttccttatgctctcactttcctttctaagttggtgtacttgctttgcacctcagatactccttattgaaagcttccagtataaacctatgagttttatgttctcctttgcttatttccattcttattatcttggcgcatagaattagcttcctggctagaaattattttcacaaaggtgggtgactgtttctctacaaatttagagaatttttaaaagttaaatatttattatgtttgattaacacagatgaattttaaagatttgttttttatgtatatgaatgtttgattacatgtatatatgtgtgcagtgtgtgtctgttgaaagtagaggccaaaggatacatcagatctccttgaactagaattacatatgattgggagctgttgtgtaggcgctgggaactaaacttgggtcctcttcaaaaagagcaagtgttaactgctgaaccatctctccagctccagacatttttgtttttttgagacaaggtttcattgttttgccctgcctggcctggagcttactatgtacatgaggtgggcctcaaactcacagaggaaagcatgtgccaccatgcctgacacccattccccagaatttttcttgaaatgttgaagtacattttaatactattgttgcataattgtgtattgtacatgaaatccaaaagaaaccnnnnnnnnnnntgactccccattcttaccatgattataaatgctttctttgtgttcaggaactagttttaaaaaatcaccattaagttttattatatattcttttttcccattaagcaaagattatatattttttgttttgttttgtaagttttattagttcaaattaggaacaagcttgcttcacatgtcaatcccttgacaggggctccctaaattccaccacatcatcctgagccgggcctaggccttccccatgtatccaggctaagatgtggaaagggctctcaaagtcccttcttacaacagggaaaattactaatccactaccaggggccccctagagtgcggaggctcaggggtctggatcagtcgtgtgatggcctcccagacagcagtctggggtcaatgtgctcccccttgtacaggccagcggtttctgtgggtttcaccagcctgctactgacccctttgatcttcattcctccctttctgcaactaagttccagagttcagttcagtgtatatctgtgggtgtctgcctctgctttcatcagccactggatgagggctctaggatggcataaaaagtagtcatcagcctctttataggggaagggcatttaggttgtcctctccaccactgccagattgtcagtttttgtcatccttgtaggtctctggaatctcccttgtgccagatctctccttggacctataatggctccctgtaacatggtatctctcatcctgcattcctctattcttcccccaactcaatatttctgctcctccatttcctcctctcctctcctgttctcctgctctcattctgtcagctgcccctcccctaccctcatgctcccaattacctcaggagttcctgcgccttcccattcccggggtccatgcatttatcacctagagtatttcatgtttcctaatttctttgaagaggattgtaggctggtaatcctttgctctatgtgtaaaattcatatatgagtgagtacatactatgtgtttttgtgactgggttacctcactaaggatggtttcttctagttctagtctgtcagaatggctgaaataaaaaaaaacaaaaacactaatgacagtttatgctggctctgctgagtagtactccattgtataaatgtatcacattttctctatccattcttcagttgagaggcatttaggttgcttccactttctggctattacaaacaatgctgctatgaacatgttgaacttatatgtccttgttgcatggacatgcaatatttgggtatatgcccaagagaggaattgctggatcttgaggtagactgattcccattttttttttgcgcaaccgcaatcacagatatttaaaatattaaatggaataatcaattcacatttttttattatttaattcactgatgataaaataaagttaattgagttctattattttctgctaaaagcaaatgctgaaaaatttctcttatcaactataattagctcatgatgtctcaaatctcttactgtgcattccgtcattatgtatattctgttatgcatatttattagtagctgcctatgttttataattgtttcatgctcacatgtcttcttttctcatttaatttttcctctgttctggggaagtggcacacttgcagtcttgtttgtttcatgatgtctgatactgtgtaatttatgtacaaaaaagtgtgatttgatgtggatattgacccattaggaacaacctgtgcttcttaagcaggaagaaagaattctcattaatcttgtactattttgtgaccatgcatttttagctgtgatcagaataagataatgaatataacttctcccacataggattggaatgtgttggtttgattgaaccatattcataagctgcagacagcattgcatgctttacccattattctttttttatttcacagtgacttaaagaaatacaatgtttattattctaatactctaaaaatccatgtacttcagcagtaaaaggaatcttagtcccttcatcacaacttgcactagactttgcacataccatggtctctgtgatttagaaagagcagtatgtgacttacaaatttgtatttttattcccttcctgaatttataaaaggaagcactgtctaatgggaaatgacttgtgagtttggaacattttagcccagtgaagcagttataggatatatagatatttggcaatatatttcatgaggaaccaaagtgtgatgcaataaaacattgccagaaaattttctcaacactcaactaaaagagaaaatactattttgaagattagtaaagctgtaagtgttggaggatggggacttttgtaaaatattgggcatgacttggctgttgtgcacatgaactcacagtacctgtggttacctgcctaagaactgcagaagatgaagccactcaaaatttttgcagcatgggcaagtggctcaaagggcctaaccacttgctgaggatttagctgttcagaatttatggtttccaggggatggagtgtcacttttatttgacctcctgaggggtgtgacctttgcttttttttttttttttgagacatggtttctctgtggctttagaggctgtcctggaactagctgttgtagaccaggctggtctcgaactcacagagatctgcctgcctctgcctctcgagtgctgggattaaaggcgtgagccatcaatgcccggtggtgtgtgacctttgcttggttaacaattcttcagtggatggcctcacagtcacacacacatgggcagcattaactgggaacaatggaatttattgtttgaaaaagaaggcatggagtttggagtagaagggctctgtggaaaatcaaaggagggaaatgaggggtggatgtgatcaagagatgttgtatacatgtctgaaattccaaaagaataattaaatattttaaaaaatagcatcctagaattgtgattgaataggatgattttcatcattcttctggaaatatccttgtagcttgagggatatgttatcatgcttggaaacttttcttctgttttgctgagtatctgaatttctgccaaacccaaggcaaaatgattgtgctcacttcctgtgactgtggcttcctcagtaaatgttttcacacatgtgaaaatggaaaataaaattgtctcaagtttataaatgtgcagttgtttgtgttatctctgatgtattttttcttgatagttctttcatttatgtttaaacacattttctagcatattaacaaatatgcgtttaacatagtcagtgtaatgaatgtagctggatcttgacagcagtacaaattagcaatagaagtattttctcaattatgagtgttaataactatttaaacagcctgtattaaacttattaaaagcttggcaatgcagccaacactacttagagaattaatataaaggtaagtacagatcaatactcctagaatgctttattgagagctacctatgaaaaatggaataatgaaggcaatgatttatggtgtagaaatgggaacaggacttaaaaatgtaagcacagctcagaaggcagcattttgagtactattactaaagcaggtttttaatatttatgtttgcagtttgtttgctgtaagtttctagtacatgaattatttcagaatattagtagtacttttatgcagagaatagaaaatgctgcagtcattgctgttatatcaactttcatgcattctgttaaatttttggtcagtattatcaattagtctcaagcacatacaaattaatttgaccaaactaacttaaatgttaagaaaccttaaaattttaatcatgaaatatttgtttaaaatgcaattttcttgccttagttacattcagcattatacctcataatagaaggaaacaaggtctttgtgtgctatattaattttaaaaggaattaggcagccaggctgtggtggtacacgcctttaatccagcactcacggggcagaggcaggtggatttctgagtttgaggccagactgttctacaaggctagttccaagacaacatgttcttttacacaaagtaatcctgtctcaaaacaaacaaacaaacaaacaaataaaccaaaaaatcattaggcacacccaaagctgagcaagtctttgaattgttttaatgggtaactttcagtatagttatgataaataggggctctttgtttgaatttgttttatttttacatgatgtggatattccaccaaggtcacatctttttttttttaagtgatatgtgagaatataaagaataagcatctaaaatagaggagaacgtagttcatttccaaagtctggtccattgtgacataatgatctgagtgtatattatttgtactgaagagtcatgggtagcaatatattgcaagacagaattttcacctgtaaattatggtgcattcatgatttaaagggggggaatcttcctaattttgaacttgagaattttatttcatgtttttcaaatcagagatactgtacaaaccaattcaataaattttcatgaaacacagagaatctctatgaatgaatgactgttcttttcccacatggagcctttctactcacacctatagtaatagtactagttgcagatttcctgcattctaacctgttactaaggtttattatatttcaggaatgcccctgaggttctcccctgggcatatctatcatctcagctaaacttttgataggagttggatagctgacaattcacaattaagatgccagctaacacacctaggagagctaagtattccgtgtggattgttgagaggagatccatgtgcactagacaacagtagttgctcttcgaccccagctgtttgactgatgttagataatggacatttaaattggggaaatttcccacctatcagtaaggctatttcacttgaggcaacttcaacctgaaaaccttgtgttgagatggaatccatacaggcagaatgtagaaacgagcatgatattacagtgttcttttacaagtaaatgagcttcaggtgagattgtttagcagcctatgacatgaatatggttttaaagccttctttcatcccaaataaacccacagctagatgtttgatctcttctgtaaaatccagtgctgctgataatattcaggttgtctccaattccccctattttcaggaatatatcccttggttttgagtcgaaatctatgtaggtggtggtggtggtggtgatggtggtggtggtggtgtgtgggtgtgtgtgtgtgtggcatgtgttttaatattgtactgtaccttctttgatgtcaggttcctaatgagtttctttgagatgcattcttaaatttgctttttcaatattcatttatcaaaaggtactgaagactgaagtgctgtaaacagatttacaagaaattatgttatcataaatttccccatggggattaatatttatttgtcaaggaataaaggacaccctgaaatagatccaaatctatatctgtattaagcattaatgaatatttctttcatatagaaaatgtttaagaagtttgtattgtgttagagcccagcatatgaaccttgattgaaatagcataatgctattattgtgagaggccatcaatcttgggatactctttgatcttaagtcacactgtaagttgtaaagtattccttccatttacttattcatcattacattcttctgggaatggaatagaggatgtgttatgtttagtcattaggaggcttttatttagttatctgaaattattttcttaaaatctaattgatggatactatttgtatatatttataggacaggttttgacattttaatagatgtatgtaatgtgtaatgatcagatcagggtaattgaaatataaatcattccaaacacttatcaattttttgtgctatggacattaaaaattatctccattagctattatgaaatacacaattaatcgacactaattattctcttactttgctgttcaacattggaaaacattcatcatattatatgctatttgaacttattatttttgaattatttacaagtaataataattcacatgctgattctagcattcactttcatgacttctttctccttttaaatgagcctgggaattaaaaatatactattttagaagagttgagttgaggagaaagaattccaaatagattaacatttcaaatatgtgactagacgtttctgagctatcaatatgaatgatgctagataaatacgaataaccaaacacttctttagagatggaagaaacatgtttctggcatgctgtgaggacatatatataagcatgttgctgggatttttctgtttgtgagctcgcaagtcttgaaatcaaacgaaattattcaacttacttttaaaataactattcggttgttatttttttaatttatttattagttctagttagggaaccagcttgtttcacatgaaagtccctttttcctctcccttccctcacctccatccctcctcccccacccccagcctacccccaaccccacccacccaccactcctcaggcagggtagggccctcaacgggggctcagcaaagtccaccaagtcttcctatgctggtcctgggcccttctccatgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatagtggctccctctgatattgtatctctcatcctgctctctctcctctattcttcccccaactcaatatttcttcccctccatttcctctcctctactcttcttctcttgctcttattgtagcagctccctcccccctaccctcatgctcccaattagttcaggagttcatgccacttccattcctgggaaccatttatcccttgtttttttttaacaattgaataaatgaatatactttattgttgggagttctcttatcccatcatggttttgtatctctgccgtgtgcatatgatctggagtcacctttgacagtgtatttcatcttatttgctcttacttttgttgttttgatcactcccagagcttttctatttcattactgaacttttgttcacaccttagtccttttggaaaaggacatcattgaaagaggatgggggttggttttgcaaaacaaaaaaggaagtcattcaatttattgaaaattgggaaatttgaaatttgaaattcaaagagatgatgaagtaaggaagttagtggacagggatggcacatgacagtctgcaacattctggctgagtagagaattctgtaatgtcaaacaagcactgctattcccaaaccaaaaacaactattacattttcgctagagacttctcaatacttttctagcagactgactatcaactcatatttactacatgttttgacgttaattttaaatgtttgtatgtaattacgtctctgtgttttgatagtccatcttctgtagtattttcttctctaaagaaatatggtattaattaggaagtagaaaggaaaatagattttcagggatgttctattgttttatgaggatggtagatggaaggaacaggttctataatgagtatcctgctgaatttttcacaacctgtgtctagaatactgtgcaacaaaaagtgtatttgggggtatcagtactatttttattgcctaaagtttccctttctttcatgatggaaaacaaaatgaataatcaaaatgaaaataccttactgttttttgtttttgcaagcaaatacatccattggtgaatttaaggtataatttacatcatgaaatgaaagagaaacccagcaaagaatgctatcaacaaaattgtttggggttactactggggacggaacattatacaccgacctgtattgccagacttcattttgtaacccaggctggccttgagtttgtgatccttcagcttcagtcctcagagtgacatggaactttgatgtgttgcagtagatctggcttaactgataatttttatattacttgttgagttgttaataatgaacttgtataggaggaaggtagcaattgcaaattgctgagtataattctgagtataatttttttttctatttagcattgtggccaaagaaaatgtagtcaactttatatttttcatctgggaaatggagtaacttacttgattttatgatcagtaaagctatacatttcagtgttttattttgtaacagtttatttgcaaatgaagacaaatttattcccagtcagcctgcttccctccctttcctcctccctccctcttttgcatcttttcttccaaaaagattatactttatttggtgtttaactgtccaaaatgaggagaaaagtagctattacactttctatagtgaatgaacctataattccactactcagagagtctaagcaggactattgtgacttggagacttgccctgattacatttatgacttttaggccagcctgacaccttgttttataaaaccaaggataggcatgtagctcagtggtagactacttatcaaccatgtgcaagtctctcggtttgatctccctggtacacacaagcaaatgtcattagcattttgagaaggctaatgaaattgtagtattcataacattatagtcctttaaaagatgtttatatcttgagagacttattacataaaatgtgtatcttttataaattactatacttttcaattattctgaaaataaaaaaaaataggccaggttgtatatactaaaggatgatatctctttcatattttatcatgtaataattatatacatcatatgttagctattatttttgttaacacatattcattctacatagatggcttatttcattgtaatagaaaaataaagattacctttcacttaataattgacaatacacattaaggttcctgttttgattaatgtgttttcgttaatgattttgaaaagtttcatttacatcaaatgtattaggaaatttatatttgtcaaaggttacaaaatttctcacgttatctagtgtatatagtggtgactatatacagtaaataatagtataatatactattgaaaattgctaagaaaatatattttgtactgttttcaccataggagaaaaatgatgaggatatgagaaatgtatatgttgttattccacagctttatgaataagtcatgtgtatattataaatatatatggtttccactactgaaaatacaatgaataaaaatacatttacccatataggtacaagcaaaaattacatattcgccacagtttatttctcagttttatatagatatatttaatataaaatataaagattaatacagaaaagacaaaagtttctatctttaaatttcatgctcttagtaaacaacatccaaagaaattgttcctttccgacatatgtgtaatatcctgtgctaaaaatatccgtgaacattaaatttgtttgatctttgtctacatagcaatcaccatgtataatgagacgttaattacatgtttttcacattgtacctggtaggtgagaagaaaggttgcatttctgtttcgtactcatcaaagagcaattgtccttcagctttccttgcccttcttttcttatactgcaggagaattcatttaccacttgtttacttcccagcagaatcagaaagcataatatacaaactgggttagaaaaaaggggatgtgagccagtgttttgtgctaatgccattgtttttcctgattgcagtcaaggacttactttatttatgacagataaactctgtcaaccctttttcattttcaggatttgcagattaggaatgtgctttcttggaataaattcattttaacaaaattcaatggaaccaacagaaattggatgtcctgtggagtacatgatagaattttagctatattacttagctttggaaaataaaccaatacatttttttcttgtggaagctaacattttattgtaaatttgaatggttagatcagtaagccatcagatttagtaagttttctaacataattatagtcacaattgcaaacatatcaagatgtaaaatatgactggttttggcttgaatatgggaaatgttctttactcttgctttttctctatttactatagattgagaagtctattttcattttcattcacacttgaaataatttacgccattattgctacaggatacaactttgtattatacttttataacttttaaaggcagatgcaggggaaaataatcttcactgcctagcctgttgatatttaaaatagatacagttaaagctatttcctagactatctccaaagtaattcaggcagactaagaaattgattttaataatagggaactgttctctgagagaaaatttgcagttagttttgttctttaagaagactattgcatgcgacttgaggtattgcagtattttgttataacagtatgaaagagaaatttgtttttatataatgtaatcaacctgaaaaggtgaacattttctcctcttaaaagggtgtgaatcacataggacatagcaggatcttgtcagtgagactgatggagagaataaatgcagccagagagaacgattggatgtcttctttgggaatttctaaggaaattgtaatctatcacagcattcaagaaaagcctctgagaggcaaagctggaaaattaacacattcaacctttttgtgaatcaggagaaataagcggtcagcaagtgtcatgcttcaaagcttatgcacaaatgcctggaaatggcagcattgcatcaaataggtatattataattggtcagaaatagttcatgcatttatctatgaaagtgaatcatttcaaggaattcaaatgcctagttctaatgtatttactttcatgtagacaaaatgaatggatacaattgtctttattttaattaaacccaggtaaagcatatgcacgttgctattgtattcttttttattttaacatctgctttttgatggatgtatatattgaaagagtgacaattataaaattgatttccttcaagaaaacatcctttaaaggtggttaaacaatgacatttaccttcattactttttggagttactgatccatgaagtaaatatacaatattgttttgttaggttatacagtggtcttacttattcatgtggatctcattctctttatccaagtacatataacctaaattttgttataattgcattaatgaacattacatcagggacattgtattaaaatatgatggttttgtctcaaaattagaaagacaacatttacaatattgttctaagtatcttaaactacttgaattaattgtttcatgtgttatatttttttacccattttctgattccccaagaaacttagaagtatcaatcattttatttgttgttccagtgatttgggctgtagtatcggattccacatgggattagagcaccattagagagaaatcaaatcttttgcacaaaacacaatactgtctctactagcctttagcactgcacaaacagtgataaagggatgacatgactaatattgctctccttcacatgagaccaattgcttttacaacttaagggacttagtgtagaactttctaattttagctttaactcctttgaaaggttgctataaatctagagaatcttatcaaattgaacgtataatcactgtgtccttttatatttatgcatgtgtataatagactcctttctccaccaaatattaaggttatatttgccagaaatgcaatgagctaatactgagcataaatatctaattcttgataaaatattgaagttttgtgaaagattgttctttatgtagatctggaagagaacaaaatttaaattcttttaatagaataactacgtttagagaaaaatggattcttttatacttccattcaatgtaaagtttttttttcctttgatcattgatcatgttgatcagtataagtgagccattcccacttttaaactcttaatacattttatttaaaaaataatattttattaatttttaagaatttgtgcattgtttatattcaccccgactacttccagatctactttcctttccatacacacccaactatattccttcattttttttatttaaatcattgagtctagtttatgctgcgtatatactcttgggtatatggccattcattagagtacagttcacataccaggaactatacccttaatacaaacacacacaaataactgtccttttctagtcgtatatcaattatcaataggccctggcttaggaatggaacttcaggctcccatccaccactccatgctgggaatttgatgatgtttagcttgaacagttcctgtgtgtactgtgatagctgctgtgagttcatatatgtatttgctttactgtgtatagaaacaccctttgattgtaatcataaactgcgtctggctcttacagtctttccagctcttcttttgaaattatgatctctgagccttgagaagaaagagtgtgacagtatgatatagatgagcacaccactatctcttattctctgccctttgatgagttgtacttctacatgttaatcacctactgcgaaaagaaactaatatgatgaaatttgagatgtgtatttatctatgtgtataacagtgtcacttggagttggtttaatactaagtccattaagcagagtaatagaagttctcctctagggcctatgaacttgtctagccacaggttcttgatactgataatggtgccaattatgggatccatattgtggagtgggcctcagatccaatcagatagtgacatttatggtacttttgtactagtagacattccttgccaggcctgtatatctagctcatagccaaacaagattcttgattgattttctccttccgtagtgtgtatagcaccttctaggattatgatagctagccagtagtgatgaaacttctggatcaataccagttttgatttctcgatgttctatgagtcatgaatgctttgtcttcagcagtacacatttgccatcaagttctgaaggatagacaagagcaatggcaataacataaattcaagtttgtgcatgaattataactcccaccccagtcacgcagacacacaccagtataatttccatggctttacggtgtgaatcggtagcagtaggtattgtcagaaggaaatgtatacaaagttttgaacaatatcatagctagtaatgtaatgtgagctccaaatatttaattttgacatctttgttttgaaataatcaacaggtgatgtatagtatgggctagttttctacatattttgcagaattacttttcattaaatgatgaaaagttatattaatatttttgaaatcttttatgcctaataatatactttggcctaaaactaatactatactttgtacattcagggatttgctttgtaatacgatagaaaataaatattaacttgatcttgctatcttatttatattttccattccattcaggaactgttctcaatcctgcattaaatgaacatgaaaaaccaatttcaacctgtgttggtagtgctggtggctaatcccaatacttaacagtcgaaagcaggatgaatgaagatttccagaatacaaaaatatacacatacatgaaactcatgcatgcatatacgtatacagaagggatataatacatagaattagaatctgtatatattctcctataaaaaataggcatttatactgtgtgggctcagttatcactgtgtgggctcacagagtatagcccattgatggatggtggaatgttttcttaattgtccaataaactttggaaatggtctttaaattttaacttcttcagtagcataccagattttccactgtttaatacctactgccactttttatacatatggttagagtaatgtctcagtgctaccagcacctgggaggcagtaacaggagaatcgtacttagtttaaggcaagcttgttctatacagtgaattccaggacagtaaagttaacatagagagaccctgtctcaaacaacaaaacaaccccacaaacaataacatagacaaataaacaaaaacaaagaaaataatgtatttcctggcttctttttcatctctaattctaccttcttgattacttgcagattaaacatcctgcatgggcttctcttgtctttatttagttctattgtgtcctttgggaagtttcacaagcagcggcttggatgtgtgtcttgtagcttgccaagagacctcctaatttgaatgtctcctatttgcaaacataataataataataataataataataataataacataataataatatactccaatttctttaacatacatgttctttttctttactcttttttgtctcccattcttgctgataaaataccttgcctgaattttttgtaaaaatttcagttagactctggatctgtttctttagactctggatctgtttctttgatttcttacgacagttaggatattaaaaatcaataacatgaactgtaaaatatcctacagaaacttatgaactagactgtgagtaatgaatgcatttatattatgttcatagatacaaactcaatgtagttgcagcaatcctgaattcttccatgagatcttggtactggtcctattgtgtggtatgtggcacgttatggtacactcatgtaaattgtgtctcaggaaaaagggaagaaaaaatctgtttctagatggctattgaatttaaatacagaatattaatcatcattcttttttccagcgttattgtctatatctctcacaatttatcatccatagtaaatcagaaattcatatattctggttgagacaacatgggaacatttatgtctaaaagtgtaataatacctgagtcagattttaatgtaatcatcaactgtattcttgtgattctgcatgccccaattggtattctttaagagctgcaatttatgcattttgtaaaacttgtcagccttatgtgattcatctggatttctgtactggttctgtgtgctctggtagtgagagtgtttgtggttgggagtgatgtatatagcagtctagagttctgagcctgtgtcttgtttccaaaaagggttcctctacttcttaacaaacctttcctatgccactggttgtgaaattgaccaagcagtaagatcacttttaattacattaaaaaaatacgttgctgctatctcaccacccctagggactgatcccataactcttgagctggggctccataatttgaagtgttagcacattcaccgtgatgttgattctgctggtttggggtacataatttcagcaactcttacttttgttgttatagtaaaaacaaaacaaaacaaaacaaaacaaaaaaacaacagcaagaaaccctgcccagccatgtgtacaagccaacattttgttttaattaagttaaactgtttctttctgtcttttttgtctttatgtgtttttgttggatatgtgtgcctacctaccacaatgaatgcacagagagattttagctagaggctacacagtgcttaatgcctgcaagacagaaatggtgttggtaaaaatgggggcaggagaatacttacttagttcctatgtatcattagggtacatcatagttagttcatccccctatcagcaaactactcttgggggccatttctactgcaagaactctgagcattctgcttaggcttcttcttcccattggccagatgattcttcagttgagactttgtactccatcaattgtaagaaataaacttgtcctctcttacgtttcataattgtatcttttattggaataaaaataattttcactgagtgaatccaaaatgcttttaacagtgcattttgaagtctgggatgtgtgggtggctgatttcaaatgaacaaatataaatcattctcttctatcaaataatttcctagaggaagaaagaaacaatcctaataattttaatagtactgggtataaagaaaatatgagtaatatttagcattttgaaaactatttttgaagtgttaaatttgaataaatttttgatttccttttctcaaatgtcatgggagatactggaagctgtatatgtagatttgtttagactatgttaaagttattgttctatgatgatttttgaagatttctctctgatagatgaaatacagcgtgttatacttaggactgatgtctctatctctctgccactactccactgattattcagagtctttagagaaaatagctcattgcaatggatgattacatgcctcaattgaatggtagctcattgccagttatcattacaatgccacgttgatttcttctttccattatgaaaattaaagccacattagtttaaaatgagcttccatatatattgcggatgactggttctgaatctcagctattttaaattataccttcttcagtaatctgattgctctccctggtaatctggtagaaatatagattcttaaccatgctgatatatgcctcttagatgagagatagacaggcagtatcataagttactttttgattactgtgataatataccatgatgaaggcaacttatggaagaacaaggttacttggggggcttacattttcagagggttagaatccatacccaccatgccagggataaaggtgacagtctgacagtcatggtgctggagcagtagctgggagcttacaacttggtctagaacattaatcagagagaggtaactgggaatgccatgatcttttgagaccccaaagcctatcccactgtgacagccctcatccaacacgccacatctcctcattcttctcaaacagttctgccaattaaggaccaaagtattcaaatatatgagcctatgagggtattctcattaacctccagagaaaatttagactatgaaatgtaaatatacacatagtttcaatatatggagtatctcggtagtacatatactgcaatggtacagtgtttgtctagcatgtatgaagcctggtatgttctctccagtgttgtaaaatttgtgtatatatgtagttagtagcaattttaatggctatttcataagcatctgtgtatatattttgttttgtgaaatccttgggcaatatcagattgcctatctgtggttacttaagatactaaactaaaattaatatttattgattacaaatatgtcatatagcgtatgtaagctactctaatgggggcaatgatgatagagaaatgactaagtaaagacactctctttagggaatttataatttaaatgaatctgtaatgtatgtgacaaaaaccatgtcatacatcaatagaaaacattatatgtaggtgttttaaagaagaacccatatttggttgacgatttccaagggctggagagatagttaatgatttaaaatgtttgtttgatgcttggaggctttgacatataatattgtggtttccttccttgaagataggataaataagctaacaaagaggttcagagagaactccagtaatgatcatttgtctgattatttggccaatgtggtataaattctcagtctggaaaggtagatcgagacttgatgaaactgttaggctgagtagatattgaggtaatccaagtgcattttaggactgaggaatatgactaaatgttatcagtcagatattttaaatgtaaaatgaacaaaagcaaaaaacaaaacaaaacaaaacaaaacatcttaaaaaaacgaagctacacagaaccccattggtttcttcagccataagataaagttaaccaggagtaaattaggttttaatgtaaacaatgaaaaggacataggggcatttagaggaagccttatagaagaagaagaagaagaagaagaagaagaagaagaagaagaaggtattcatgattggataagcaatgagctagtattctaacacaactgggatttaatcttgtgctattttcccagtcccactaatccatttcttcctacggatgttgtggaatattcaaaacatagtatttaaaatctctagaatctgataatctttgtactcatataatcctatttatcttcagttttccttttaggtagaatctttcaaagatctttcccaggctacatattaaataaaagcatcctggcattttacttgtttagctaagtttattttacttcattgcaataaagcactgatgtttatataattggttaattatttattatctctttatttgtaggtagtagactctaggaggataagggcttagttatgttgctcattatatctgtattacatacatacttggtaccttgtaaatgctcaacggctgtttatgaaatgagcagaataaatgaaaaggtgaaggacaatggcaggtcaaacaatttagccagtatttcaggtttgagggaatcaaagggcaatggtgttactgagagaatactgtagagtggaggaagagttgatttgagggagtagaaataatggaagatgaatttacctcataaattgtggcttaaatatgtgaagctgtactatctaaaattgtgcaatataggggtaaggaaactatgaagagaggtctgagtttcagatgatgatatcagggttattctcagcatcaagccttttatcagatgataaagataataataataaggcaggattatcatatttgaaaagaaattttcattttaatatcttactgttaaacctgtgaagttacttatatattcttttccactcatagctgggttaacaactttggccatgaaggacttggactcttactggatgctctggaaaagcttctagacaaaaaacagtaagaatgaagttttaaaaaactttcacaaaaaaacttttcacacatgggaaaaatttacgtacaatgtaatatttttttcttttttcttactgacttaggcaagaaaatattgacaagaagaatcaatacaaactcattcagtgcctgaaagcgtttatgaataataaggtaaatggtgtttacttatccctctgttacaaaaggagagagcttgctcgacagtatggaagtaagaaagagataaaacagtgggtactattcaagttttaataatatgtttatggtgtagatcatcatgagtttcctataagtggtttcaaaggtgtattttgcttcccgcaatatttactgccatattttgcatttatgacaagaatattagtttagctttcaaatttgttgacacatatttccttttgtgatataatgaagtctcattttttaagctttatttatttatgcatgttgctagatgagttgatgtgcaggacatgcctacaggtgcccattcaggatagaaggaatcagatcccctagtactccagctacaggcttgagctgcctaatgtgggtgctgagaatcgaatctggattctctataggattaggtactctcaactactgaagcatctcttaaaccctagcagtatgtaaatttacatttcataaattgaatatcatttccatacaaagaaagaagttgtattttatttaaaaggaaaattcaagggtaggaatagggttcaaatagtttgataagggtgtcatttcagtttcagtgatttaacatgtgtaaaagaaatctgtgggagatagcttgcatttttgtatacatacaatactatttttaatatataatattgtggagtcttacagattaaataactgactaatatgcttaatcacattaattacatttagttgatattttaataaaaacaattacttaatagaaataaataattatagcaataaccaggaacttgctaaatgtgagtgatagctattaataatcaatgcagtaatactgtatatttacataatatacaaacacgttctttggtatatgcaattatatatcactttctgtatcatatgcccatattactcagcaaatggtattattggtacatgcagtacatggttgctaatgaactctttcatcacatatacttttactgctatttctataagtttattatcattttacatttaattatggatatgcataatgcaccaatacatacatgtgaagtccaaagtacaaattgagggtttcacctctctccttctaccatgtgggtcccagggatccaactttaattttcagacgttttatcaagtacctttatcccaggagctaccttgcttacccatctgtatgtttcttgtagaaacactcctatcagtactggtcgagaacttctcttcttctgtgcttttcacctttagatacaacacgtcatggcatccaatgactaataacaatacgcttaattgaacattgctttctccagagctcaagaagcatctctttctgcaactgaaaaaagttgtaacattacaaaaagagagggcagtactggagatcagagatgcacatcacatttccagtcctaagcagacggggcctttgaaaaatgacatagcccctggccaatcagtctcctcctctgtaaattcagcaatgggagcttttgtgctacatttttattgattcatgttgtcaactaacatagttttgtaggataacaactaattataattagaatactgactaaagtatgttatattagtttgtaggacttcctttatagccctattcccataggagatactcagatatggcaagactcactttctttttcttatgtgtttttggcagttttgaagaacatgatgatttcatttaagttattcgaaacgaaattggagtttttgtgaagctatttttatgatttagatatatatccttgtcacatgaataaacaagtcctttaaatgatagtcatatgaaacaatgcataaaacagacattctgaatagaaagcacacagtgatatattcactttaagttggaatacattttccaaatcgaggagggtaaatttcatctgaaatgacataaatgacacttgacgttgaggttagttatgtcagaaactcataaacatttgcatgttgccttatgtgttaaagcccacagtaaagtcttatttaaaaagtttagcctgctcctcttttctcttagaatttaattaagaaccttcatgctgttcctatgtttggtactttgccaaatgttatcatataatgtttcccaatgaaatgtaatgttgccatggaactaacttgaaatgaagcaatttttttcagattcttaactgcttatagtatagcatattgattataagtactgaataaatggacaattttaagaaaacatatgcactcacattacaaaccaagtacagataaactacatcattaaaaactatgatagtatgatacacagcatgttcacatggatgaggaatttgtgggtgtttctgggtgaaacatgaaaaaagcaattaagaattttaattaaaatatcaataaagatgtcacaaattttatataaaatctaattcattttatatacatttcccaagaacaatattagaattatgttttactacaagaaaaatataaatgaattttacacccacagctaaacaccgaactgaactggaatccagttgcagaggagtgatgagcaaagggatcaagaccaggctggtgtaacccacagaaacagctgacctaaacaagggggagctcttggtccccagactgatagctgggaaaccagcatgggactgatccagaccccatgaacacaggtgtcagtggagatcacagaaatctatggggttgttgtagtagatcagtacttatccctagcataggaatagactttgggagtccatcccacatggagggatactccctgagcctagactcattggggtggacctaggccctatcccaaaggacatgatagactctgaaaaccccctatggaaggcctaaacctccctgcagagcagaaggggtatgggataggcaatgtgttcgtttggggggaggcagagggaactgggattgacatgtaaaataatcttgtttctaatttaaataaaaaagggagagaaaaaagaagcaaacttttactgagaaaacagaaatatactttgtgagacaaaggtgaaaatagtagcatcttaccattaattttggatttgaaaacctacctattggcatttgtatggcatgtgcttatacacttaggtttatgcctagaaaatgagtgagactaatattttctttgcctgtctgactggggtatgtctctgagtctataatatgtgttgctagctaagagatatgatataaaaggacaaggaaatcggggaaaacccatatcatatttttagtactttatcgactatatactatacttgaagcacttaagcatttttccctcccgtgtttactttaaatttcagtgcaaatatattggaaaaaattaaccacaaattctagacattcccaaggatatcaagacattaaaagtagctttagaaaatataggcagtgtatgttctatatgttcttgcttgttagacaaataccagttgttcccacatttctcctatatattttcaaaaatgtaattgaggaatattggaaatcatttttattcatgccctcaaatttctaagatgtagccatttcaaataaaataaaacaatgaatgattgcatttgaggaaaatccaaatcattagatacctaagggcactgtgaaggtattttttttgaaacatttctttattttgggtttatttggaatgaaaaatatgttccatagacattcccattgtgtttgtttttagtttggactgcaaaggattctaggagatgagaggagccttttattgttggcaagagcaattgaccccaaacagcccaacatgatgactgaaatagtaaaaatactgtctgctatttgcattgttgcggaagacaacatgtaagtatcgacaggttctgtttattgtgttgcaaaatgacatggcagaaattaatggttcttctttttgataacttgcagaaacacagtagttcttagaatatttttggttgatatccttattttgtttgtattttacctttttggatattatataatctgaatttgttaaagatgaatttaaaatattcatttattcaactggaattttgtctcactgaagataacatcagttaagtggaaatggattaagttgaaaacgttttgagaacacataggaaacacacacacacacacacacacacacacacacacacacacacgcgtgcacatatgcacatgtgtgttcaggcatctttaattgaaacaggtatatcctttgtactattgtatccttgtattttactttatcttatatggtaacttaacattaaatgaacttatccaataaaaagaaaacatagtgtaagtttgtaggtaaatgtttggaacacaaacaaaaacagctcataaaacattagcatatgatagtaatatgtatattaattagctccagttagctgttccatagcaggaatatttttaaaaacattgtattatatactaaaaatatttgaaggttttgtctattaaaagtattgtgatgtgaaacatttaatggtctatataaacatcaaacactaagaataaaatagagaatgagctatgttcatcatatgaaatattcctcatttcctttttctcttgttttgtctgtagtctagacaaacttttaggggccatcagtgctgcagctgaaagaaataacagagaacgattttcaccaattgtggaaggattggaaaatcatgaagccttacaactccaggtggggttgttttatcataaatcacttgaagagttatatttcgaggacctgtattataccaattcatttttagctggcatttatgggatggaatgtaaaagtacaattatttgtgttactcatagttttgttcatttaaagtcatttaaaattaagaaaattgcttttttattgtcactaatacggcatatgttattataattgtcgggaagttgaagctttagcagtaatatgggccaaaggacatacagttaggtctgtagtatttgaccaattaataaagctataggcttttgtagaaatgtaagaaaatagttaggtatggtgtcatagtatggtactctttagcagtttgaagtctgagtcaggagggttacaaggttctgacttgcctgggtttcaatcaaccaaaaaaacaatttaaagaaagagaattcagtatacttctctttgtgcctttcagacaatcagaaatcagactcactaatgcagagggactgaattgtatcccgtgtcaggcaccctgtgaaaactctgtagacccagtctaaacatgcttagttctaaaactgaaaaaatcttttgtttttcatgatttcaggaaatgtcttactttatgaaaggatacattgttcttgagggatgagaagtcatgtttattgcctgtatttacagataagagctgctgaatggcacattttattttgtgaatataatttggtataattcttgtaatgaatcagctccctaagtattatccatttatcatgtggataggtagaatgagattgcatcacttgtataagtggacatggtgtggaagaaccagaatttgatgtcaacatgctctttgttttagatagtgtatataccatttgatgctccacgaagtatcttttaaaaagttatatcatcactcaaagagattttgctactatgtttattttttcaagttatttttgtgagtatacatatggaaatattctacttgatgtgaaacaaacaatcgattttttttttttattgttttatgaagtattggcatcttttctgtcacagctggaaactgtgttcggcagctgaattggccactccaaggagaatctgtagtactgtgaaactgtacataatgtttctttagaaatgtaaaaatatctttgaaaattgttctacttcaacgatgatgagtatattgataaacttctgttgtattctcttttgcattggtgtttttaaaattgagaatgtccccttagtgttttcctatctgtgacacagttttccatattattagttttagtttcactaaaatttcatactttctagggaaagcctgagatatgcattttcagatgtcttctccagtgttttgtccgtgttgctgtgttggctgtgcttgcttgcctagatggctttcactgccagacatacatatacgcctgtatgttattttcaaaatttagcatgactcaagcttgttatttagattcaaagttttcattgcatttgcaacggtttgccatatgtggcacaaatagatttgaatagttaaaaatatttaaatgaaatttcagccacaattctgtgttatatattaccttaagtttactgatcagggaactgagttgcacgaaggcttcatgattagttctctaagaatcacaaagctgttaaggtttagaatggtggtttgaacttaaatttttgatatatacatcccaaattatattgtatgtccattatagtaacacctccataaaaaagcgatgttttcattgtagagtagtttgccccagtcagtgaaactttactgacattctgtggctttcatggtgctgtacagaatagaatgattaagtcgcaactgtttaacaagtaccatatggagaaattgcagacatcttgctaaatattcaagaaattgttgaatactgattatggatgcaaacatatgcaaactacaatttgaaatttcctaatttaatgagctacaacgtttagtaatttattatatacagagcctagtactctcccaagaattgtgaagtgggtttattaggcatatttaatgtgaatgagaaaatattctgtaaaagttctaaaatgtgttcagaatactgaaattaaaaacaaaagctgagctctgttgtttaaaaaatgtaatttgtgttttttttttttttttgcagaattacttttcaattttggtagtgtcctgagatctcttattagaatatcatgaagtaattcttttaaaatactgaactaattatattttaaagcaacagtttcttacagatgttttctagctcagctatgataggattttcattactttcagtagtttcaggaacagatcagggataaattacatcaacatatgtactctcttcattgccttacgttcagcttagttgcactattcagtctgccatgctgtgtcacctgcagttttacacttgctagcctctcatctgcctttttaccttgtagcacttgtctctcagagaacaatctatacttctttcctctattttctaaattatctttcacaacttatctttgtcactgtcttaaaaagaaatctttaatggtctcataatttcaaaaccaatgatttcttcccaatggtggctttgtccactgaccatttgacaattttacttctcttgcttctctgggcaccactctttttgggtggtgtctgaatacccatttattctgtttctaatgcatttttgctcttcttcacaagaatatttccactattttttaatcactactttctaccaataatcattttatatgcacctacttatatgttgttatgtgtatatgtgccaacatgtgtatgtgctcataaatattcatgtatattcatgttttttatcagactcccacaagtaacaaattaaaaatatcacttgtgagtgctattccacaataacattgcaatttacatatgtaatctcatttaaattacacagcaaatctgagaattatagaagtatctcatgaggtgatatttgagttggctttcaaagataagaatttcaatgatattatgttttctaataaagaagccataataaatttgaatggtgcaagaagggcttatagtgcgtgaaaatggagacctccatagtctttgtaattttagaaatgaaagcagaagaccatacagacatccgcttgaactttatttctgtgtagcaagacaggaaatttcaaagtaagctaaccattagtagtcttttataggtagagaaggtaacattaacatccagtgaatgcatgttaaactcatccattttctcaggctacagttaggcagaaatctttcatgtgtttgcagaatttcagaagttgtggagacaaatgtggtagcatggtatggtagacattaaactgctttctagtatatcagaataatggagaaagtcttctggtataataattgaatatagtacacaaaagcatttcacacaatgtattgttcataatgtgtgatagcttctctcaggtatactacatttacattgtataggcatcctcttggcatataaattagaaccaataatgaaatgaaggtaaaaatcaaacattgatccttcattgaaatcatcaagtctatcaaaccggtttcatgaaaagaaagacctggcagcctttaatcagaacctaagtttgttttcttgcattatcatattgagactgagcatctgatttctgttcatggcagactaagggcacaagttggaagatgtgcaggaagggagagctaagtagatgtttagtaaacttctgaaactaaggtaactgccaatgagctgagttccaagtttatactacttccgtatgcatgtatatttgtgtgtgtgcatatgtatgtatgtatgtatgtatgtatgtatgtatgtatacacgtacatatacacgtacatatacgcatacacatacacatgcacacatacatacatacatacatacatacatacatacatatatacatacatagtagtgtaccattgtgtagacaaatttggacaatagtgttaccttttcattgtaacaagaaaaattctgacttcaagtataccttcacttttaaatctgtttcaaagatgatgaataattgtgtatattattacagtagtaggtaagagtgattctaagcgtttgaaaaggagcagactactttcaaagctatcacattgtctttctagcactatttggcattattgagcaggactacacatacttaacttgtgcccgtccttttcggctcctctgtgctttcgcaatgcttcttttctgtgctcatctccttcttcttctgccagtatctgccatttcattttcatgtcaaaaatattcacgaacctccctcttaggataactttttccaaacctctcatggatccctttctgattttaggatctatgaccccatatacacctgtgaaaattcaaaccaaaggtttgtgcatacgagacaaagttgtatcttgggacctttggttcttcatttttctcattttgatgatttgcccactgtcttatccatctttctgagttcagcgagatacatgtttgcctatgctctttgcatcccagtccattctccctttcaaacatagaatgttcaagttctgcattacatttaactatgttcatcttcaagttatacatcctgaacctctctaatgtcttttctcaccacgacctaccattttcttatattccttccttcctgatcattatgcaagaattaacatacaccaaaaatgtaatagttggcttcaaatccacctgtaatatatatatatagtactatatgtcttgcattccttcagacagtacatactggattgtatgttaattttgtacttctttcaaggcacagtatctctctaatcgctatgctgctgccagtagttattttttcttttaaatttcagggaattctctttattttagtctttgtgctgacttctttttattaaatcttctacccttcattctaaccctttaaatactctccggcaaagtcactcttctgacatgccattttggcacatcactacttacaattcttcaaaggctttttatgacttctaggattaaaatctagtctttgtgtccctccttcccaaacgaatagataaaagcacgtcaccacctgcttacagatttctaattgtgtgtttcactagtcttctgtatacactttttgatggagtcatactacgctctccttcatgaacattttgtgcaatttcctctctctacttctaatcctttgtacataaatccttcttttgtctagacattcttctccatttcttgacttaattaacttgcactgtacatttgaatagttcttagtaagtacttattttgacttaaacaatctttttcccccaactcctgctgtggctaggataaagaaagaccttgttaatgtcagcagagcacttaataaggtcaaatgtgtgacagtgtcaataaaattttaaaagcaatatttgtcacagctaatggcaatatggataatctgtctgagaatgccctagagttggcaattactgtactccataactctaagaattgtgatcaaacaggcagacaattttttgcactttctgaaacttgttagttgaaataaaagcttctcttattttcgtagttattttgtgaagacattcctgtatattttaattttattcatgtattttatatgcacttataagagcatgtatacatatctagtacatgggatgtttattaaatgcatatgaataaaatacagataacatcaaattttcctatgttaaaaacaatttaataagaacaggcactgttgtacttacttgtttagcataagaattatggtcctaccagtgcatatttttattcaatgagcaaaatttactgacttcctgtgatatttttaaacactattttttcattgactctatattagaagcacaaataaaaaatggaaaaaccacattgaaagttaaagcccttaaaaaaattcttaaaaacagaagaatctggttattggaatttgtgctattcaattcaagtacatttgtattctttctggtaagaggttgaagttaaattgtattcagcaatgctagattggcacattgtaatgtgtagaagactgcagtactacaataagtggtgctagtttcctctttttggcttattagcgttttcagttgagggagatcacttcatgtttgtaacccacatatgaaacaatattaggttgtttacttcttttctttggagagggattattttaaaatcagtttgattttgctctctaagaggacaatagagttcagtcacatgtttaaagatttatatccttgggtgctgagcatcaaagttttggtatttgggaatgaggtttgtagtcatttcagtctgagctctaacaggccagaaccccatcttccttaatgttccccatggagttctgttctgtcaaattttctgcagtattttttattcatattgtccaatgtgggacctataaatcacatgtatttttcatgccattggactatagctagtcaagtcaagttcttgatttagttcctattgaagttaatctgtggttaaaagagcctggtttgaatagtagagttctgtaatatacatgtacttgtatttgaatgcacattctcatgtaatatggaactccttgggggagagcaaaagggaaagaggagacattaatttgactatgggatgctctcaatatgatactttatgagatgtatatggaatgacatgtactccaaaccaaggatcagttcgtccttacctatttttatttgtgtttcattatgtatttggtaactcctttatatatttggtaacttcttgttctagacaacatattgttacattatttccatgcttttataattatggatagctgtaatgtagatgttctaattcaccaaacatgatgctacagatacgttttgtcaccttatacaaccttaaaatttttcttgtattaatctttgtgtggagtttctaagatatctgaaacattctggaattgttttctacttgacataaaatagtgtaacttagaaatataattttcttttgctatttgaccttgcataagtcatttatcttctgtaagcttcaacttttccatgtgtgaaagaaatatagttgtaatttacatctcattgttttctatgagagtgactttagatagtacattatattaagcacctaatacattgtctaaaaatttataaaaattatacaatagagataagagtgtagatttttgcattcagctatttgtattttgtatattggatccacacaatgatatttcataataaattgttgtgcttcttgaaatattatttaaattttcatgtaagatattttgataattttagtttttaattcctaagttattgttctctgaaagaataactgtagcatagatgaggacaaataacagtttttttcttaccttactagtaagtgtgtgtttaaatgtaattccctaggagttttaatattgcagttggcatgttattaatgagagatcttgtagaatttggtgagccataattggcattttgttacctattcttttttgactactgtctttcagtcatatcctacttattttatatggtagactctatgttcacctttttttaaaatatccagccatgtttgtatacattatctgtaaagtacttcatagcagtgatatctttataatgatatatgatatcatgttgctgtagttagtaattttaatttttactattttatttcattagtacaatacttctatttctataaagatattgttacaagatttactaacctatttcttatgagaatatagtctttatttgtaaggtattaaaatatacattattaagctagaattccttctggcaaaaagaatactagcatatgtaaacatttctattaattttcaattgggctttgtcttgttaagtcatgtcataattgttacttaacaagactcattcaagaaaataatatagcactgcatacaatatataaacacatatactagcctattgagactctataaagatttattcaggttcttattgtataaaggaggggcctgtaatcaattagaatgaaaatgcctaacaacacatccagtattagttttaaggtgatgcaaagttttttgatacacatttagttgtccaaatgtttattctaggaatacctgagcattcctatgaattggaatgcagtgttcaattactttttctctatgtggtaactttgttaacaagctcagctttctattttaaatgaacaaacaaaaaaaaaacatttgaatttggtatattacatttgaacaataagctgagtgtataacattttgatacaaacttaatgcaatatatgttttaatgttttctcattgttttgaaaaatgatatgtaatgcaaggtgtgttgaagtcaacatatgcaatatttctatcaaagtttgttttcaacatttttggtttattcatctttctatatatgcttataatttttgtaaaatttagtattttccttgagtttccttgtactctactcttctgctcatataaacaaccagctacaccaggacatggcagcaccccagttctcgagcaggaagcagtcttgagaactctatgcccatgttccctaacctcccatgcttaactccccacctttttaataataagtaaaggtggaaatgaaaggttcaggcagatacctaggcagctcgaagtgccctttgttgcgttgccacgtcatggctacatcacacattacaggactgtgtagggagggagtctgcacatgcgcacgcttcccattttgagcctgcacccttatccctcctctctctctctgtttccagtgttcaaatgctaattattctctgttctgctatgctcttgccttcctctctctctttgctctctcactcgttctgtctctcttactgcctccccacccccacgctcttgctctcccaccctgtaataaactggttcatgtactctctattgtttggtttccatctagtggtttcttttctaatttttaaactcttacagaagaacaccacttacatcagtttaacgtacttccatggaaagaatacaagctaatacagtgatatctcaaagttatctaatatagcttcacaaaatttttgatttatactggaattttttttaattgttttcccgagacagggtttctctgtgtagctttgtagaccaggctggcctcaaactcgcagagatgtgcctgcctctgcctcccaagaggggttgagggagtgagccaccaccgcccagctggaaatgtttttatagctatgtagaaattagttcccttactatctgtggaaaccagatacaagaattcatttcatgatcttttcatagggttcagtgtgtattatttgggaacctgaagtttctttgggaaagttaatatcctttcatatagtttagcaaagcaaacacacttaactttcatattgttaaaattatgttggatatcataatcttgattgctaatgttgcttataatacgaagtcttatcaatatacttacagaaatacttgcattccatatgcctttagtgaatctgttacctgcatgtattagctaagtatttctttactgtacctaaatatataaatggcatttactttctctttttaggtggcatgcatgcagttcataaatgcacttgtcacttctccatatgatcttgattttcgaattcatttgaggaatgaattcctccgttctggactaaaagaaatgctcccagtaagttcaatgtttctatttattgtactactgaacttttaacttgttttccctttcaagtaaaggtacttttttttcaaggaaagcacaaatttgtcctttgttattgcttcaaaaaaacctgcactttgttaataatttcactatacaatggatgattcatcagtcagctaataataggatgtatataaatatgaattatatatacatatatatttgcaaatttgctttcctctttgatacttttgattgattttatttatagtcagcataagtatgcatattgaggcttgactagtatatttgggatattttgcttaaatatggtattcttattaggctgcttcagatcttttcaaaagagaaatagttttaattctttatgaagtccatagtaggaattagaatcctttgactatatgcctaagtgtgatataactgtgttatatctgtcatattccttttttactgtgtaaagtttgtttaagttgtcaaacatttattttattgaaaatgtatggatatatctttcagagtttgatatttgatatgaaaacttaccaatagatcaggattcataaatgtcacccacacccagagggcctactttggttccatgtaggttctctaggagctgtcagctcagagtctatgagctcctactagcactggtcttctgtatccctggatttccccattttgttcttgccccccccttgctccaggagatcagcccaatgcttggctgtgtgtcattgcatctccttccatcagttactggatgtaggttgtatgacaattaaggtagttaccaatctgattaaagaggaaggctggttcagacaccatcaccactatttctaggagtccttagctggggtcatccttgtggattcctgagaatttctttagcaccagatttctccctaaccccataatggctccctctataaagatatctctttctttgctctccccttcaatccttcccccaacttggtattcttgatccctaatgttcccataatccatccccaccattccaccctgcctcccagtttaccctcctggggcctcccatttgtgtccttcttagggttcccctttttacctagcttctctgaggttgtggattgtaatctggttatccttgctttacatctgttgtccacttataaatctggtactgataaaacagtagtgttgaacacattttctttgtaaagaggagaataagtagaattacttgctctgaaatgtattttttgatgttctgaatgtgttctggttgcaactgccttctgtgctcatatggtaatatgacccataaacattacataattttgtattctaataaacctcttctgcttgaaagtggctggttatatcaaaaagttcttagtttaaaagaaacaaagtggaaataattttatttgttacatgctttatatgagtgtacttaaaatatttaaaatgtattttaaatgttttatagggtttatttttatatatttaaatgtgttaacaatttggtacattcttaagtatggagattcaaagaaagaacatcaaaaagtgctttgttttgtgttttgcttccataattgccattacatccctatttatcattgttcttcttgaattaaaatagaaacaaaaatagaaagaagaaatgcatcctgttttctttctttacctaatttgaagtacaccttgcttgcatttcctttcagagttcaagctcagctctgaacatcataatcccagttttggtatcacccttgagcatccacagttgtgattatcgatttgagttttcaaagctgaaacttaatggacaaatattaaaagattttcctggtgatatctattaagcccaacaatctctagtctggcatgtttccaaaattttcatattattattatttggaaaattataagaggtttgtaatgcatgtgcttctgatgtattacaaaaacaaatctttgatgaccaagttggtattttgtaattaggctaaatgaaaatcaaagtttggcagggcagctagctatatcatgaatttaaaaaaaaaaaaacttagtaccttttaactttaaaatcacaaaatatcattcattataaatttgtttacaaaatttttctaggccgtacttgggactgttgtgcttgaatatatccttgcattggtttttcattaacacaactgatctttattgcttcattttctcggtgccagaggcacctgtgaatgttctaactgcatggtttcttttgtgatttctgatgagtatgttccgtcaaaacgacagcattgaattgggttgtagctattagtgggatttttgttgttgttgttgttgttgcagaagtgattgttaatatttttaatgtgaattgcaagatttagagcatggaaagaaaatgtaaagaatggtatgaggttcttccattttgaaatagaaatctttagctgtatttattttcttttaggaaagcaaggtcaatatttgaaattgcatctgtgtacaaatgagtaattttattctgcccctgattagcaggtgtgttatttttaaattgtcattcattttctgaattttattgttatattagggtcttaaagaaaaagagaatgatgagcttgatattcagctgaaagtgtttgaagagaacaaagaagatgatctaactgaattatcccaccgtctcaatgacattcgagctgaaatggaatatcctttaacaaacaaaataaatacctaatttttacacttaatgtttaaaagcaggacttgaggatattttttatatttcattagtttttttttctatgaacaatgttgtaactgcttatttatattagtgctccaccatgatgctatccttgatacccatttgtgctgacaattgctactttgctttgatgatgtattcagactattgaaagccacacaattaattactcagtgtattagagatacactctgctcagtggtcttgaataaacaagagcctaagagccttaagcagtatatatttccaagaatgagaaaaagttctttgagttcatatgtgataccagttaagagatattttgtttttattaaatgctactccacttatagatacaattttctggaaatgagtatcttatttcttatcgggtatttgtgttccttaatgatagcaaaattgttagatacaataggagctttctataagaaagtagtgctataaaagtacctacatcatatataacagcatataatcttcctgtgccaactgtctgatgtgaaattgagacataagatatgattgtcacagttctgcaacttatctccctcccattaaaatttatacttttggattctatgaagtaggaagacacttgcgaaccaaagtaacctctgagctgtgcttttctacctttaatattttcttatctttcttctttcggtattctaaacaaacttgaacaatatttccctatttgaaactcccttattactttatttgacttatgtgtttttatgtactcttctcctctctttacatgaaaatattgcataaatgtagatacaatgtatagaaatgttattatcataggaaataattaaaaattaaagtaattcaaaattaataaaaacagtttttaatcaataaactgctttatatttagtgatataatcaattatttgataattttgtagccattcaatgtccttatgttactttaactcagaactctgatgtggtgtttaaattagtgcattgtatatttaattctactgcccatttcatggtgtttcaagatgttggattgcatcttgtcttttacctttattttatgtggactttcaatatactcagtacatataatgtgagtccaatcttgaagtttttttctagactactaccagcatctacaccactagtttttatatcccaaagaaaaaaaaatgtcctaatgtccatggacttttcagaaggtcaagtatgaacacaacagattttagactttttatttgggtatttaaaataaagctaggtttgtgatcttttgatagctgaatacttgcttgatatatcttttatctgaggataaaaatagaatagccctggctcttttggacccatagagagatcaagacaaagcctccttcaccaatagctttgctatttgaatggtcctaactattatttgaagttgataatataatggatgattattattttttctgtagatgtttaaatgctgtatcatgaaattgaaaccttattaaccataatggaaactaagtagtaaatttttaatttaaaaattaggctgctttagtcataaatgcactgtccattaagaatctttgatgttttcctttactttctttctaccgatatgaatgaagtctaccatcttctctataacatgctgaaagacactgcagctgaaagttacttattatccattctgcagcactttctactcatcagaaatgattattatatcaggtaaggttcatatgtgagatgactacatgtataatttgaattggatattaaaaggaagttaacaaggtagtagggctgaggaaatatatatgttatatgtacataaaatataagtgttttactacttgaggcaacatttgaaaaaaagaattcatttattttaattgggccaggaaagataactgcatataactatggtgtgcatgcaaccagaatgtaagtataaattaacctgtcgtatattattgaatatgtaataaatttttctgcttgatactgctagaatgtcttaaatcctcctattttaacaagtaaagttttatcatttctttttatagtgtttagtaaatgtgtgatcttcaaattcagaaaagtattgtgtatattttactttttgtaaaatatgataacatatagagttatactttagaatagatgataaggtctatatctaaaaactggaagcatatatagcaagaggcttatgggtgactgaaattataggctcatgaccatggtcttatgttaatgacagttcaaggtcctcttacttgctttacactcttctatgtttgcaattattacatactagtttctttggattctcaaaatttgcttgaataatagaaaaagaagtgatattagaatgctagttgtattgttaacaaaaattgataattctaaaatagcatatagagctatttttttcttcattctactgcagtgattggatcacatcatgatgtttaggagacagaaacatgttgaaactactaatgcatgctttttaaaaaccactataaattaaaatacataattttattatgtatttattatgtattcatgattattcagttacctaggaacaagatttgccagaagtacctattctcaataaatactaataaatgataaaacatttacacatggcatccttaaaaattttgtgttatatgagtatgttctctctctctctctctctctctctctctgtgtgtgtgtgtgtgtgtgtgtgtgtgtgtgtgtgtgtgtgtatgtatgtatgtatgtactatgtttgtatgtatgtatgtatacagtatttgtgtaattttgtttccgtgaccacagacagaggccagaggtcaaattggttgttgtgctctgttactttctttcaatttatcttgagacagtgtctttctcactgaaactggaggactactgtcagattcctttggtccttctagcaacaccccagacagttacagatgtgcatatccatgcctgcctttttacttaggttctaggcatttgaactcaggccctcctacttgcacagctagtgcttctatctactgagctatctcctcagccaataccatctttcatcttaaggcattcctgtgaggtagaaatgtgtgacaggtgctttcattccatatgtagacttaataaaatccccctcaaagagaagagttgtgtttttcttagttatccaaagagtgctcatcacactgaggttaaggactaatactattcatctccagatctgatggtgattttcaaatccctagccatgcaatacgtatttctttttattcttagtcttaggaacaaccacatgattaaatacacagaagggtaattagaatctctttttcattggtttagagtttttagtaggttgacaagctatggttagtggtgtttatattgtagtttgtctgaattaatacttttctacaatagtgttgaatttattaaccaatgaaaatttgtctcccacaaaatttaaaagcaaaatgtcttttatttttccttttccagtcagcaatcattattaaggccagaattaccttgggagattacggaagtgtgatgtgtttttaaaacgtttgataaatcacacaaattactgctatagctgtgcctattaagtgtatatggcttcataaaatagatgttttttgaagcatgttgtatacataggtttttgcattactgtgtaacagaaatgcctcagtccagttttataaactggtgttactgtcctgagtaaatgttcttcactgaattcaagacattgcttgccacctaatgccaagaatctcatctttttttgaaaatgagtgcttgtggctgtctagagctatttctgtgctcatagatataggactagggggttattcattttcattaactttagaaacaataccttaaataaatagatggggttgataagtatttttgaacacaagcatgagtccctgcaaactagcatattaagtcagtacatattttcagtcgatcacatcacactcaatttggctccctaatgttcagaccatctttaagccttaatcatattttctctaaggaagtgcaaatgttagtggaattattttcttattggtgctggagaaaaactaagttcttttagcattctctatcccttcataagaaaattgattgatacaagtagaaaagtattctcaaatattttctctcctccttttaggccacagtattataaaataattgaggagtgtgtttcccagatagtgctgcactgcagtggcatggacccggacttcaagtacaggcagagattagacattgatctcactcacctaataggtatggattatactctatactgccattcatgggtcacaccttctgtatactgagcacattgaaagggtaggtctctcactgaactctcttaaaatctggtaaatgtttgttgttatggatgctcaactaatacaactatttgttttgagaatcataagaattctctttataggttcagatatattaatctttttgataaatttcactaccacatagtcagttgacaattagttgtcatgtgtcacaaaaatccatgattttttttttaaataggtgcatgccttgctgtttaaaagcatgactttagtatcttttagttcagttcatcctcacagaaagattggggaagttatatgtgcaggagagtctcagtattatagacatgttactactggctctcaaatttgagaaaagaaatgtcatgaaaaagaaaatagctcaagtaagaatgccatgtagaaacattgttgtaacagtctgatcagtgatgacaagcttctcttttgctatatgttatgctctatggctctgtagtaggtaattgtatttatagatggttaaaactatcattgactaggatgaagcatgaagttgcttgtttttaatgaataaaaggttgttgaataccatttatataatatttttcactacattgcagaggacagactcacaaaggagtcagagatttaacattatttctcataaataattttttgtttcttactataggcaatttagagatttctgtaaatgacaaatatcaactgatcaagatcactaccttttaaatgaatacattttaaatagccctttctttatgcacatgtctgcctttgaatgtaactacttctaagctgaattttcaatgagcactgtgaaggtttgactatgtttgcattcaaattggatctgctaactacatgtcatgttatgatctatcatgattatttgaaatactgttcagttattgttttctgttattattgcatctagattgttttctcatcctcaagattgtaaaagaatctgctaattgatctctgtcaccaaaaatgtattttaatactcagcttaattgaacattctcacatgtaaatgctggacattttctcactgctttttcacagttaattgttatcagtgaagataggaatttcaaatgccaaatatttttagaaatcttgaacctttaactatgtgagctacaacctcttctagttgtttttgaaaagttgatgattattgtggaactttcattagaatatccacatgcaaatacacatatacacaaagttatcaagggcttcaccctcctccataagatgcaggggtctctatatgaatatcacttggacctgagtattccagtctgggccgatttcacatttctgtacatcaaatgttttttcttaaatcatagcagatccttttctaaaactgttcaatggcttccattggaacttagatagaaatcaaagtaaaaatcattgtcagctatgacttatattgcccatataaagccagtttggacaatacaactttcctgattgtatggaacattctaacatttttacaacatgaaacacattaaatacttgtagccagagagagggcttaggagttaagaatacttcctggtcttgcagtggaccttggctggacacccatcacctacatgacacctcagaaccatctgtactctgcttgatcctatgtcctcttctggactttgtgggcactgcaaacatgtggtgaacagacatatattcaggaaaaagatccatacatataaaataatataaaacaatcaataaaaattgataaaaatctttcttatacatttgagtggagaaaattacttatattttaatatataagctaatcaatatatatatagctaataaatatattttaagtacattttttacactttacaatataaattaataaatgtatacatatattaatgcattgtgtacttaaaaccatcattgtatttaagatcataagctgtattaattccttaaaaatttgctgtcttctctccttgtttttccctactctactcatacactgggtatgtcactaaaagtgtcattgaaaatagaaatacctactaatctctcttatactgactttattttagcttaattttctctcaccagttttctttactaaaatcttatgcaactagtgtcatgtagcaatactatctgtgactatcttgtttcatcaagcatcatatgtttgagattcatccatgttatagttcatctattgatagtttgttcctgtatattgtgaagtagtatttatgtatgaatattaaacaatgtgcatttcttggtggacagttttgttctttccagtgttcaactattgtaataaagctgttatggttcatttatataaatgtgcaattcagacatatgtttcattttcctttggagaagtattggggtaatgcacatggatataatctaagattaaagaggtttttgcattatgtttattaactaggcctgaataattttatgtttgcttccattttacaacatacagaagtcaagtaaaagattttccctgaaaacctgaactgaagaatgccactgcgtcatcctccccagcgttttagaggatcattttgagttttcattatcttgaaaatggagtttttgcctccagtctctatataataatgtgtgattttccaatgaattctatagtggtaaaagttgaattataattaacgcctttaatttcagggacaatttcatctaagatatttattaatgcctgaagtttttgctttaatactaaagaaagaaaatgtggtattatttgtatattataatgtagattaattttcttttaatgataattcatgtgagaatttcagaattatatactttcagccataattagctagatatttcatctcaaatatttctaatcatttttgcttcatctgaatagatgcttgtgtaaacaaggcaaaagttgaagaaagtgagcaaaaagcaatggaattttcaaagaaggtaaatgccaaaataatagtcctgcattttaaattaatagttcaacccccagtatgtaagtatgtacccttaataacatttgattttgtatgacactttataacttgt

SEQ ID NO: 3 - DNA, 414058 bp, Cricetulus griseus
  misc_feature (16047)..(16356): n is a, c, g, or t
  misc_feature (56000)..(56014): n is a, c, g, or t
  misc_feature (112642)..(112675): n is a, c, g, or t
  misc_feature (373665)..(373906): n is a, c, g, or t
  misc_feature (387573)..(388011): n is a, c, g, or t
cgacggggggggggggccatcgcggtgaccccagcagtggcctcgctgccgcgcgccgtggctgagccgttccgactcctcggaccccccgggccggatctcacccttgcgcgcagcggagacagcggaggcggccacgggagcgtgaagcagcatgtctgacaaaatgtccagcttcctctacattggggacatcgtgtctctgtacgcggagggctcagtcaacggcttcatcagcaccctggggtaagtagggcgcgcactgggcagcgccagccggtccaggtctctgtccctcccgcgcggcgtgtccggggtctgcgcctgggacagccccgcgtccccgaggtccccgcgctcaggaagccgcgagcgcttctcagcaacttcgtaatctccagcccgagacacatccgagaagaggaagtggttcgcacgccccagacaggccccgcgaggcagccttccctggcgtctcctggcttgttttgattaaaatgtatgttttctcctcgtcttccctccccacggcccttctcagcgcccggctggaaagagtggtgggttgaagtccctggcttcggccacgaaagtaggcgatgttgcacagtgcaaatgcggcattgtcccgctggaggagatcaccagcccctcttcgctgaagtaatttccttttggccttgccaagggaagactcacccctttggctctgccaaaacgggcctcgtgggcagccggggttctagaactgggatcttcttttttcctctccatccccctcggccgggtgaagtgaactgcaaggctctggagattccagttggtgtatgcactggggaaataggtttgtgtatcctgcagaacaccagcgtgctagttaagtagggccttttgtgatttctagaaattccttacatggcgagctgatgcagttagttgcgccttgcgatatgttttagtgcacaggtgagtttccgctctttagactctaatctgggagacttgagattggtgactgttcactgttgagttttggagttctgtctcctgagctgtgacagtgtcacctgcccaatgccttccctggaagtcaccagtggtgtcctgttctttgagcatgtccccacagatttgggggaggaaggtagatttaattccatatctcctgcccatcagtttactccggagattgaagtgtggaagaactcagtgcaagtgtccagccgtttctgagagaattcatgctccaagtccagtttgggtccaggacagtgccttgctgacgaattctgttgaacttacacttgaaccttggcagacatggagggtgtctgccatttagcagctaaaaggaggggctctagaaacagaagggttgggctggaattcccaccctttgacttgcaaaccttatgtccctgggcaggttatgaaatctagctaggcttccaactcctcagtctaaaaatgggactcagtggtttctacacaggggcgtggggagcaaagaggtaagcgccgagcatggcagagctgtaatgactacattcaccagttaattagctgatgcagtaattatcgctgcatagcctaggcaagagttcaagggccaggatggactttgtctctgtagggtcactctgcaaggtcaaaggtgggtagtgtatgaagcagatactgggagagctaaggtggtccagcttccacagtcgtggagttgtctccaggaattgttgagacgagtcgtgaccactgcaagaagcagagggcctttgtgtccaaagccagaactctactcctgacttcgactccttgccaagcgtatgctactctgctttcccaagtgacttcagacagaaaaccagcacgaatgcagtgactgtggcaggctcagtggtgtcacagcgctcgctgtgctcagggtttcttgctggtgatctgaaagtggagtttcttcagaatgtgttcccagacggctatcattctctattcatgaaataatagtgttgagatgactggcaaggcagagtccaagttgaagagtcttgaacatgctgccctgggcggagcttgcagctttgattggatgtctgtctattgaagtagacgtctcggaggttcaggtagctcatagaactgcagaggtcggcgttagtgtgattgctcccccactcctgcactccggtatcaacaggttttcaaagggcagttacagaagtcattgctgatgttcccagatagaattttctggcccttggagaatggtgttcaaagggcactccagggcagcccagggcatggacttcagttggctgcatgagtttaagtcttatgaagtaagggaatataaaggtccttcggcatcttacttgacaagtcctgacatcttttatcagtactttctgtttagaaaagcatgccatttctttcacatttgggaaatacctaatagtgttcaacctgaaattattaattatcttatcaatataaacattgtgtgtgagatctgcaagtaatgtagaaacttcaaagatgttttcagaaaatgcctggcacatctgatggggcttaagttgtacagcaaatcatctcattgatttttcttattaatatgtagttttaaaactaggggttctgtcttacaaattttttttttcaaaattcaggagtgaaaattttcaactattgagaaataattacgtttagttttataatggcttaattaaggtcctggaatatatgggcagtgtcccattgttatatcaaaatacctaagattatcagtttgcaaggaggagacatttttgttctcacagttttggcttcagttgtacagtctatggattctgttgctttggaactacaatggcatagatggcaggtgtctgtgagcaggggacagagttggagcatgccaccagtgactcatcgcctgtccccaggtgtgtgtggtgtgtgtgtgtggtgtgtggtgtgtgtgtatatgtgtgtggtgtgtatgtgcgtgtggtgtgtgtgtgtgtgtggtgtgtggtgtgtgtgagtgtgtgtgtgtgtgtgtgtggcatgtgtatggtgtggtgtgtgtggtgtgtatgtgtgtgagtgtgtgtggtgtgtgtgtatggtgtgtgagtgtgtgtgtgtggtgtgtgtgtggtgtgtgtgtgtggtgggtgtggtgtgtgtgtgtgtgtggtgggtggggttgtgtgtgtggtgtgtgtgtgtggtgggtgtggtgtgtgtgtgtgtgtggtgggtggggttgtgtgtgtggtgtgtgtgtgtggtgggtgtggtgtgtgtgtgtgtgtggtgggtggggttgtgtgtgtggtgtgtgtgtgtggtgggtgtggtgtgtgtgtgtgtgtggtgggtggggttgtgtgtgtggtgtgtgtgtgtggtggtgtgtgtgttgtgtatgtgtgtgtggtgtgtatgtgtgtgtggtgtgtgtgtatatgtgtgtggtgtgtgtgtgtgtggtgtgtgtatggtgtggtgtgtgtggtgtgtatgtgtgtatgtgtgtgtggtgtgtgtgtatatgtgtgtggtgtgtgtatgtgtgtggtgtgtgtgtatggtatgtgtgtgtggtgtgtgagtgtgtgtgtgtggtgtgtggtgtgtgtgtggtgtgtatatgtgtgtgtggtgtgtgtgagtgtatgtgtgtggtgtgtatgtggtgtgtgagtgtgtgtgtgtggtgtgtggtgtggtgtgtgtgagtgtatgtgtgtggtgtgtgtgtggtgtgtgtgtatgggtgtgtgtgtgtgtgtgtgtgtgctgcacatgtggaggtcagaggctctgctggagattttgtcagtttagggcagatgacagtcacctagcaagaggcaatgtcagttgaggaattgcctctgtcagattgctctgtggacaagactgtagggcattttcttgattaataaagtccagcccactgtgggtggagtcagccccaggcaggtggtcctggggagcctaagagagcaggtcaagcaagccagggagagcaagccaccaaacacatttctctgtgacttctgcttcagttcccgcctccaggcctctgccttgaactcttgtgttgacttccctcgaggatggaccgtaacctgtaagccacataaacctaagtcgctttttggttagtgttttatcacagtatcagaaaagcaagctaagacagaggccttccaccttggccccctgcccagcagtgacaggagctaaggactacacccttaacacatgggcctttaggggacaaactgggacgattattattttgtaggttctttttattgtttgtttgtggttaactttttggaagtttttttttttttaaattagcttatgaagtcttcattatgctgttttctaaacatttttgtttgtttgtttctcttccccccgtcgccccctcccttgttcccttccattattttgacgccacacatgatcttttcatgcatgatttcaacgtgtagggctttatttagcttggggaaccagaagggtgtatgccccagccaagtaaaaatattttaacatcttttattattgtttgtgcatgggtattttgcctgcacgtgtgtctgtgtgtcacgtgtgcagtgcctgtggaggtcagaagaggccactgggttccgtagaactggagtcacagacggctgtgagctgctgtgtaggtgctgggaatcaaaccccagctcctgcaagagcaggccttgtctctggagcctcacaagggaagtcttagctaggtgattgtaattgttggagactctagggctgtgaagccagagcggaacaacagctgcttccctggctacatacgtgttgctgatcttcactcacaggcctttgtatcactcgcagagtagagactcctccatgggtttccttgctctcctgctccttgcgtccgtttctcaggcctgctgctaaccggtgcatgaccttgctcacaccatgtatctttttgtaagtcagcctcagtgtttttgccttggagaggatggatagcctccccttgaaggtatgaggcaatctagctccagagacaaatgaaagttttgtgaagtgaaaatgtatagggaacagctatatttccatatacacaattacaaattttcttcaaaggttaaggagctggtggagtgaactaggccagagttcaggttcagtaatcacgatggttacacgtgtttagccaaactcatatgttccactgtaatattccaaattccagggagtagctaaaagtgagccgtgcaagtctccgctttccatgttacctcttcagtctctggtacttgcagaagcctggtggcgctgccgattggaagcaggtgggctgtgatcagagctggctttataaagcacagatgttgatttacaaatgaattttgcctactcttaacattttatggcatgaataagctttaaaggctgttgtttggagtgtctgcagtgggtcttcactgtttttttgagttcaacacactcctcatggcagcactatgacaaaatgagtctcgtaagcttttcagggtgattaaacatagagttgtctctgtgagtgtgtgtgtgctggcatgagcgtcacagcacccgtgtggggctggagggcaacttttggattcagttcactcttcccttgtggttgggtcctgggagggaactcatcccaggatgtgagagctagtacttatgaaccatatcaccggcccttctgtgtggtttaaagacccttgagcatgtggctgcaaatatccatgtttcccagttttcctttgagtggtatttatactttggaaacagggttttctctgtgtatccctggctgtcctggaactcactctgtagaccaggctggcctcaaactcagagatccgcctgcctctgccttctgagtgctgggaataaaggcgtgtgccaccacacccagctgatgtttcttaatgtgtacctaagatctgtattatatacccttgtgttgacttgtggaaaaattaccttacatcctagatagtgtatatattttaaagaactgatttttttaaatgatgtatcctagagttagtttcctcattttgtttcttttctttttttctttttttaggcaagaagggactgagaatgcactgtgtagtttccaatgcagggcaattggtcctctggttttccttattttctattataagccctgctctccccatgttgatgccacagctcctagaagatacctatgtttctgactgcatccatagtcaggtgctttggaggtaggggctgagtagcatgaggtggtggggtgctcgggtggtagaaccagcttcaggttgtccttccttccctgcccactcacatggtttctgattaggaagtgaaaaggtgtgtgtgtgtgtgtgtgtgtgtgtgtgtgtgtgtgtgtgtgtgtgtctgtgtgtgtggtgtgtgtgtgtgtatgtctgtgagtgtggtgtgtgtgtgtgtgtgtgtgtgtgtgtgtgtgtatgactgcattaacacacatgtgcatttgtatgtgtgcatttcagccattgctgtcctaatgagaacctaaaatacatgaccagttatggacatagttggtagccacacattaagggcttagaaagctgcctggtgagcagtggttggcaatctgacttcagccagtcctagtagtctcttagagtgacaaaagccagttcaactggcatctctagtcacttgtttcgtcttcaatagtgggcatgtgtgagatgggtcacagtggttccagttctgatccgattcctctaggagtggacttgaaaatgcaggttatgttgttccaatcagggccccttgcatttctatttcttggtttaacttttctttgctgttgttttatttttaatgctgtagagatagggtctcaggctggtccctaactcaacagtgattctgctcaagagctgggatggaagcaggagacatcacatcctacatgatttttttttttttcctgtgaagcattcgggttttgctgtttttaataggtgtaggtttgattcatttctttttacattttttacttaactgttattcccattataattttaaaagttgtttgatggggaaagtccttctgtgtatgtttatcttattggttgtaaaataaagcactgttggccaataaggaagcaagataggtgggactaggagtccaggaggattctgggaaacgtagtaaagagaagtcttgtgatcctggcaggaagtgacatagcaggcagactctgaatataagcagggacaagcaggaaatcactctctttctcccccctcttctttgtggagtcgccatgtgatccccagcaagagagggcacatatggccggtgtcctcgataagatgcctttataaaatatatagattaataattatggttgataattaagactgagttagcaagtaagaaatcctagttattggccagcaacattgtacctaatataagactctgtgttattttgggcgcccacatgttggcgggactcgggcagctggcggaaagatttatcgttacagttgttcccttaacaggactgcaagtggtaggctttgttcttccctacaaatatgcagatagcctggcttttctcaatacacctttaaaattgacaacaacttcatatttatttatttaatatgtatatgtgagcacctatatgtgtgtgtgtgtgtgtgtgtgtgtgtgtgtgcgcgtgtgtgcgtgcgtaccatgtgcatgcctgatgccactagagaccggaagaaggtatcagatctccagggactggagtttcagatggttgtgagctgccatgtgggtgttggcagctgaacctggatcctctggaagagcacccagtgctctaaccactgggaaatctctccagccctggatgctgtctcaaacccagaggtccctggtgactcacacacagcttccagactctcgctcgcatcagcagctcagtaggtaaattgccatgctgtctcacatgcccagcacctggtggagagagacaagatcagaggcttattattgaggtctgaggaactgcagctcttcccacggttgctccctttggactgttcctgtgtgactagtgaggaaacaacagagaggatgcagacggaagactatggacctaaactcaacacactccatcacagatgcagggcatgcatcataggcagatgtaaagacgaagccatggattaatatgacaggtttacatggcaaacaataactgtacatttcacttaattaataagtaatgcatttgggggggacagggtccatacagtatctaaggattctttagtttcttttttttttaattttatttattatgtatacagtcttctgcccgcatgccagcagaggcaccagatctcattacagatggttgtgagccaccatgtggttgccggaaattgaactcaggacctctggaagaacagtcagtgctcttaaccgctgagccatctctccagcccgattctttagtttcttattactcttcatgaacagtgcttactttgaaaaatacaaacattttcccagtcacagtcaatggaggaaaacctcaaattaggcaacacagcacagctatggttattatttaagcatggatcctagttgctatttatgtttttaaagtgtagcatggtaaacatttgtctgagcagacgtgctgaacggttatgatgcctgacttattttgttaaagcgactgtgcaatctgccttattttcgatgtacttctgcaggtaagacacacacgtgtgggcatggatcatcggttgtgtcagtaatcctcatactaagcacgggtctcctgttgactggaccagtgtctaccgcctcagtttgtgacagtgccttattggcacgtgactgagataatccaggagcgttttagttgactattttcgacatggaggagtgaacactatccaaattataatcaataaatggttaagaatagctgtagaacattactcatccacagatcttcaatcttgaattgaggatgagttaaaatagcaggctgttgagaatcaaagaaaatctttaatgataaaactggaaatatgctgtcacgaacccagttcatgtgactgtcctcagaaagtacttaacgctgaaatgtcctatggattagctgattggcttcattcattcattagttgtcattgagcctttatgacaggctgggctttcatactgaagacagagtgtaaatccttttgttaaaagctggcttccctttgagaacttgtagtttgacatttggtggggatctgtggggacataaacacacccaacacctttgctctcaggactagaaaccaacaggcacttttgtgtcttttgaatcctttcatttccagtatcagagaatttctgagacagagcgaggactctaggaagcccctagaggtgtttcatgaatagccgtggacggattcagtaatgggcagaggagatgggataagaagagccctgtcaaatgtcaggtgaaggttagaaactatgtcacaggggcttggaagagccacatttcttcctgtcccgagggtctgacctggttgaaggggcttcaaggaggaggtacaatgtgagctcaactcagcatggatggacctctgtgtcattgtgacacccatggtcactggcacgttctcgacattgtcttggtataccattgtgacacccatggtcaatggcacgttctcgacattgtcttggtatacttttcagaagtcagcaaaaattcgttcttcactttagtagctctcaaagtcccaaagcaaatattttgatgttgttgaggccagcagagattgaggaacaatttgaaaacgtttttcatgcttcacccgatagggagatttgagcttggtttagaccccctgcaactgtcatgacatcttccagacactgaagcatgtgttgggtttacagagatccatggcaatgacactgggacctgggagcctagtcaggaaggaaggaaggaaggaaggaaggaaggaaggaaggaaggaagaaaggaaggatctggagtgtctttagacagtgcacccactccatgaattccaggcttctactcagttctccgggtctccaaccccagggttgtatagtggttgttttctctataaattgcctcctattgattgtctccagcttccctgggagctttgggaaaagaattttcatctaaaatgatggttttgttttgttttaaggtagagtctcatgctgtgtagttggggctgggctggaatgcaaaacgtggtgaaggctggccttaaacttggagcaatcctcctgagtgctggaattataggcatgtactaccacacctgacttaaagtccccctgcccctctcattcctgattcttggttttgctactgtaaagagcaatgaagatcacggattcacatgagcacaggggagggcgagggaagtcgacagggtgtaatctaagctcctatctaaattcttagaattcagacactcgttactgaggtcctatctgaagtaagatgtttgtcactgttaaaatatcagaaaaaaattctttctgtgctgattatcaagctcgggacttttattacgtacagtcattgttaatggacagtggagccccagagaagtccccagcagagcccctgcggctactttcagggatcagccagagctttccctgcacagtatctcctgctgaaaagtgcacatggatcctcagggctcaacataaaggccaaagggccaaataataagcagatatagcaaaagactggaaccttaaactaccctgaaggttgttcattgcctggataaactggcagattgaagtgtctaatttcccaaggtttctgagagggagatggcgtccaattcctgttccatccatatttaattaagccatttgtgaaccttgcagtgagttgtcttggtaacctcatgtaacagtttatggataccccttgtgcccggctctcactgtctgatcttaaaagacctgaaggaatttgtctatcacactgctctcacgctacccactggatgaagctggaacattgaatgactggctgagttaggctctttgttggcaataaacagaaaccatccctggccagctcaagagcaggaaatgcccccaaggacattgaagaatctcaaggcaattgaaaggagggttcccagtgagccatagagaggtgagaagcatggccacagggctctgaacagggagggggaatctcctcactgaatagcatcatgaatttgcatggggtccagcagttatgtatcccctgtctttcatgttaattgttttagattatggactagtagaattatttggattaggtaggagtcattacttgtggtggtttatcttggttgtcaacttgacacacctgagaagattaattaaagaattgtcaccatcggattggcttgtgggcatgatgatgggggctgtaaaataattaatgatagatataagaatgcccagcccactgtgggctaagccatctctaggcaggtgggctgggcctgtatatcaataaagccgagccaggagcctggtttctgcttcaagcatctccttgagttcctactctaacttcccttgatggtgggctgtaacctttttttttttttttgatttttttccattcatttatttagctcatacataaagtcatgcacaattatgatacataatacagtgtgttcacaatggcatggctaaattaaaccaattaacatgttatatcacacatactcatttttgttttgagaacacttatactatctcacaacttttaaaatatagcatattgttatcaaccatatttatcatgctctcagtagacctcaagactccacagagtccatgcctcttgtccaactgcagttttatatcctttttttttttttttttttttttttcccgtgacagggtttctctgtgtagctttggagcctatcctggcactcgctctggagaccaggctggcctcgaattcacagagatccacctgcctctgcctcccgagtgctgggattaaaggcatgcaccactaacgcccggctgtaattttatatccttaaaccaatcatttccccattgctaaaagacccacattgaagcctaatagccacaattctgctctctgttggtgggctgtaaccttaaactcaagcaaactcttccctccccaagctgattttggtcatggcattacaacaacagaaaaagctacctggaacattacatgcccgggaaggcagtggcactgcccagatccggctagtatcaccgagctaagctgggctttctgctactcctggggcagtgtagcatgggccatggcaggaaaggccatggccttcgtgaaatgccacaacttgcaggcaaggaaagctgtagtaaacatgtaggccctttgaagtaaattatgatatagtacatatactatatactatattgcttgatatcttggctgccttaagtgtgtgatcagctcaggggcagtgagtatatccaggcagccagggcttctatatgtcagagactccgtcccgtctgcatcctctttgcctttcttggtaacttctgaactcctttctatctctaggaatttgcttattcaaggtgcctcttgaagacaggttgcgtaataaccctttggtgactggcttattttatgtcataatgtcaccaaagaacaaaggtgagttacattgggatgtatgtactttaaggcagctaagtgtctatcaagaccaacttcttcctggggggaaagtatcagtgtaattgttcttacgaagtctttgagatccacagacagaatttagagtaggggagttctcacagtaactggtgccatcccatcttgctgttagaggtctttaaaatccagccgtggcaaacttacatcagaaaaagtaatgcatgcgacctttctttggtggtttgtagctgccgccacagtgaacgaaagttgatcccttcccagttcagttttgtccctataagcttgaagagtgaatttgtaagcacctcccagtctatttcttagctgagattagccctttgtcttagtggataatgaagaattctcctaggacagattgttttgctctaactcgtccagaaagaacttcctgataccaaactcagagaacagttcaggtgttaacatgcaactttagaaaaaaaaaatagcaggatgtgtttcactttgtaacctttatttttaatattcaagaataaatgttgaatgagaggcgtttaaatatttcaatttaaagagacaaatagctgttttttttttctttctgattttgattatatccattgatgtgtttggcccatgtgtaagaatttgaagctccctagcactgtattgactcatgttcttgaagcctcttgagtttaatacacagactaattattacatacatgtaaaatagggatgaaaggaagaaaatgtggatatgtacaaaccaaaaaaatttgataactaaagcaatattatttaattgcctagttctagcatgcgatgatcttctatgagagatatttaaaaacgtcttaatattagaaatttaagtttgacttgccagatgtggtggcacatgcctttaatcccagcacttgggaagcagagacaggaggatctctgtgagttcgaggccagtctggtctccacagcgagtgccaggacagccagggctacacagagaaaacccggtcttgaaaaaccaaaaccaaaaccaaaaccaaaaaaaaaaaaaaaaaagttgcactttgtaaacataacttaaaaaaaaaaaatcagctgtccaggtccccaccacaaagcattaatccaaataagttaatgatttagcaacaggtctgttgtgtttagagagcgttcaaggtcattgttaatatcagggacatgaccacttaaacatttgtactacaggctttttttttttttttttttttggctttggctttggctttggctttggctttggctgtgttttctaagagcaggaaaggtagtggaagggattggattcttaggatgctctgccttgacttgggatgacagacccgtaagagacattcattttaagtcaaaccaagagtcaaagctctctatgaaaaccgggctaatgagcaagggcttttatttgcctctttctctgtttacctgtcagtcatgcctggaacacttgtgagtccttgctttgtgttggagagacgggaagagcttgcctccagccgtgttggaagcatagagagttttctgctggttagaggctcagaatcagcatctgtttaggtcaagtgttgtagaggaaatttgtcaggcggtaatttcttaggcggtgaacacccaggaggttagttcataaccgcactctgaagaatggatcatgtcctaggcttgctcctcagcagtggaaaaaataaaaagacaataagaagagcttagcatctctccgagatatcttcttcaaagcaggggttataataggcatctttattttagttatttaaaatatttgtgtgtgtgctcctgcatgcacgcattgcattggaggccagtcatgaccctcaagtgtgctgtccaccttgtctctggaacctggggcaattaaatagtactgctttagttttcaaattgttttgtagtttgtacatactcagattttctttctggctgactttgaactcaggtcctgatgcttgtgtgacaggagctatttctccagccgtattctaagaaattctaaagaaataccaacagcctcgtgtaattggaaatctatgtaacaaaatgcatgttaatgtcagacccatctggttattcctacaaaatcttttttccccattttcttactagcagaggacttacatttgtgggtggtcaggataaagaacacattccctccactccctttccctccccccaccctccctctactcctcttttccaccacagactatgtttcagaggaagaggatgccctttgaggaaggtttagcgcctcactctgaaaaggtgtttgcagcatgagcgtgggaagaaagcatcttgggccacagagatgaggccactgtagctgccctgcagacgttaccaaggctccaagaaaggaacctgctctccagatggccttaagtctgcctctgctgttttcacctaagaaaaggtggcacatagtgggtggtcaagggccagagtgcgtttcctagatcatctgtagacggatttgtaagcaggagagggaaacagttgctttagaacagtcagggtttgctctagaatagttgggtttggtctagtggctgagaaggaggacaggagaagagagagagagagagagagagagagagagagagagagtctgaaccaagcttcttgccacagaggcactgaagggacacagcctttgctctgtttcactttagatctaggaaaaacttgggaatttggacacccaccactgctgctgaggctctggtaccctgaaaactaaacatacagatttgagtgaggtttttatttgctcacatctagataaaagtgtcatcagttctcacttgactccatgttttccgtgttctgtgctattgcgctcactcaggtagaatgtctgattttcttttcagttgcatgaacatcctccacaggatgttccccatgcattccccactgcctggtcagtttccgttcttacctgcctgcctgtcatctgctcctcattcaaatgtcagcggtgacttgtttctgatctccagactgtgtgaggacagtgtattgcagtggtggttttaattttcattgtttttttgtttttccttttctggtgtggtgtatgaatgtatacatgttcgtgtgtgtgtgtgtgtgtgtgtgtgtgtgtgtgtgatgtgtgtgtgtgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgtgtgtgtgtgtgtggtgtgtgtgtgtgtgtgtgtgtgtgtgtgtgtgtgtgtgtgtgtgtttcctttgcgttgaggccagaggtagatgtcaagtgtatttcctaagtatctttccctcttggtttttgagactgagtcagtctctcactgcgtctggagcttggtgattggctgctagaccagctgcccattgaattccaggcatcctcctgcctcttccacctcctcagtgctgggattaccgtccccagtttgctggccacctggatttttatatggcttccaaatattgaagctcaggtcctcatgcttgcatggcaagcactctccctgctgagccgtcttcctagcccttgattctatttctgtgagtattgggttgtcctttttctccttttagatttaaacaaaagggcggagtctacattaggtttgtttgtagttaccttgccggggtcttgccaagcatccatcggatagaacacatccaagaaatacattgtatcaatgccctgtgctgtagcagatgatctggacttcttctgccttagacaagtctggtttcaaattgtgcctctacttacttttctcacagtgtgatcctcagatgttatttaaccctgacacctagattttccttatctgtaaaatgggatgctagtcctgtaaggaggtcagtatctcaccttactaaggggttcagctatgatcaacacttgtaaaacaggcctatagcaccaggcacctgagcagtgaaataagtgcacgctgtcttttagtctttgtaagatcatttgcaggaatccctctgcagcggctgacctgagctcacactccaggggtgctggaagtagtgccatattgtgagctgatgtttgcttagctgttcaaagtcacgctgccttatcaattgtttgttttggttttgatcttttttttttttcttccttatgctgccagtgtacatttctaaattgccagtgcttgggtttatctttctgttctggtttgatgcatattatcctctgatgtactggaaagcacctggatgtatgagtgtgaataataacttcgcttatggtgtgtacacggtcatatgctcacttctccaccctgtatttcctatggctagaactttcaagttttgttacattttaacgctaaggatttttgcttgctaatattttccccctaccagaatatagtaacaaaaggaaacattttaaatgtattgctttatccttttattgtgtgtctaggtgtgtgggcatagcacgtgtgtagaggtcagatgacaacttggtggattcatttttctctttctacctctgtgtgggttttaggcttgaactttggcaggcagactttcacaacaagtgcttttactcactgagccatctggctggctcctgttttgttttatttattgagacaaaatgcacttgtttgcagccattacgttaaaaaaatcaccccccccaccctcccggtatctctgagctttcagcttggccaagaattgggaattctgatcaaacttctgctactgttagggatgagcaaaagcatttatttatataagataattagccagtttacaaacatatttatttaggaaaaagtgggtcaagttttaaatagcaactaatcaaattataatatttcccttggaaacacttgtgaatatcaaacaaaatttgagaggattttactcctgtctcttagagctacccaaccagcaaatgtcactcaggctttggcagtggttggggaaatgctttaaaggggccagaggatgtagctagtctgtgtggagtatttactgagtgtgcacaaaggcctggggttgatccccatgcaagatgcaaaccaggtgtggtgcctgtttgtggtcccactcaggaggctcaagcaggaggatcagaagttcaaggtcatgctttcaccgagtctcaaatagcccagggtatgtagggagtttgaggccagcctgagctacttgagacccggtaagagcattttgtaaaatcttgctcgaaaacttctctgtgagcagctttccattggctcacgtctcacatttcttatgggcctctgaagcagaagggctgctggtaggcgcgcccaagattaactggtggtaagattgggtttgaaaactgccacactctcaggcatggcaaaggatgaatatatctgaagacgctaattttattagtcacatatgatttggggcacaagaataagaaaatcccagtcaaatttcctggcttgacatctgtttgtccactctggaatctcctgacctggagactgcaggcaggtggactggcccccagtggaccaagcaactgcaagtccgctcacatcattatgctagtctcactcccacccaccaggagagggagtgcctcagacccacctggacccactgggagacccatcagagtactggactgaaaggattttgtggtgagagtaacagtaagtgtgcatccaaactcagggcccctggccactgtaccgcaggtgttagcctcattccagtcaggtactctgtctatggccacctgggggtgctggtagcttcctccttcctcctcttctttctcccagaagtgatgagtgcctgaagccctagaatcagtacatacacggtacagtcacaaagcgaccgatgctgcagtggcttaggcagagttgaaatttttttagctgacattgaggctggaggatgagcttcgggggcaacaaacgggatgtggtcagcaccagagtgggagaagagctcttctccatcctacagtcagggctggtggcaggaaggcgggactctggggttgagcaagctgtggtaacctcacacccactgtggccagtgccttagcccccagccctcagaaggctgagttctctaggtccttaggaaactctgcagccaccaattactcagttctcagagttctctttcaggtcactgcccctgggctctgttttagacctgctttaggggcggtctcctgatggggagtggtccgatactgacttctcagcccctgggaagcctcagtcttcagagctctgctttgtctccagccagtgaagaaaggttttcagggactctgctggagggtgcagagggaacccagtggtttgctgtggtcagtgatgttgacacctcactgttaaagtggaaagagttcgagaaacagcgtttttctaaaagcttattgttcatgcagcatttaattctctctcatttgtgtgtgtgtgctcgagtgtgtgtgtgtgttctagtgtgtgtgtgtgtatgtgcatgtgtgtgtgtatgtgcttacctgtgctatgaaacatggactggtcactttgcctatgtctttcttccctttctttgcagctcatcatagtaacggaaagctcttccctgcctgtctaaaatctaaattccacgagtgtggcagtgtgtgctgtcccatggccagccccttggcagaagcctaagtgttgacagaaaccttgcctaagttttctttagcagatttggaacttaaaaaaaactatctattttttttttgaggatttcatacacgggtgctatattgacataatttttacctttccctctccctactcccatgtccctctcaaggtcatgacctcttcttttttaattagtcttggaactttgagacagtgaccggaagcttctgcaggaaacgctctgtgtcccctcacttgaggttgcattccctgaatttctgggtgcctagatttagacacagtgtgattttctttttggtgttctctgattcctgggctttgaagacacagctgggccagtttatgttttggtttagtatttatttattttactttatttttaacaaccagtgaagtttaaggctgtacccatttcctctctttatttcttgctttaaatgggggaaataaagaagacctgagtgttgccccatgtgctgtgattgtagtgtagtttgaaaataaccacctaaaacaagctatttagttttgtagctagaggctggagaggtggctcagcggttaagagctcaggctgtttttgtagagcacctaggttcattttccagctcccacacggcagctcgcagccacctgtaactccagtctaggtatccattgccttcttctggcctcctggcacatacgtgttacataaacatatatgcaggcaagcaatcatacacctaaaataaaaataagtaaaattttaatttttagagagccaattatttctgctttccaaatatatccccgtatcaataaacacaatgtaaaatcaaggacttaagggctgaagagatgtctcagcaggggctgggcagtggtggcacaggcacaccttttttccagcactggggaggcagaggcaggcagatgtctgtgagtttgaggtcagtctggtctacagagggagttccaggacaactggggctgttgcacagagaaaccatgtctcaaaaagctaaaaaaataaagtgcttgttgtgctcgttactcttgtagaggacctgggtttgttggttcctccttatgccaggcagctcacaactgtctttaactccagttccaggggatctcatgcccctctggcctccacaggactgcaggctcatggtgcacattccaagcagacaaagactcacatctgtataaaaacccatttagaaaattaacaagacaaagtgctgggtggccaggtatacttaaaataaagcaggtaagtgagggcatgtgatgtcactaacttaactttgaagggtggaacactaggagagaagacacgggtctctcataactgttactctctggctgatccagaagaaaactagtaaaggacagggacttctgttggtgacactgagtccagagtgagcttggacaccatggccccttcacaggccttcctcagacaggagcagaggaaggattcgaaggagtcttatccttcatgctaatctctgtgcctcctggagggagaggccaccagcttccacggttgtggcctttcagtgacaatgtccttagtgtgcaatttacagacccacggttgaaggcttgtctgtctcctactgtgtgtattttctcatctaatttataatgatggatgacattgatggatggcatggtgacttaatgctcaaagctaaaacagcgtaaatgaggaaggctggaagttttggtttagcagagaggttgactcttgtgaatctgcttgttcctggtaagtgcctgtgagatgtggtgactgtggaaggctgtcccttttttaattagaattttggtgggaaatcttcacaacgataaggccaatgaaccttaaaagcagcatttaaattaaaatctaaaaaatccattgaagggaaaggaatgcgaggggttggggagatggctcagtggtaaagcgcctactgtgcgggcgtgaggacccttgttagagctgggcatggcaagagtctgtaagcttagcgttgatgtgagtggatgttgcagatggagacgggcagatcccagggctggatggcagctagtctaacctaatctgtgaacttcagctccagtgagagagcctgtctcaaaaacacagtggggcgcgttggaggaagacatgggggcttccacacttgcaggcacaggccatatgcatgtgtaatcctaccccaccttcaggaaatatgaaagccagataaagtgatacacacatataatatttagttatggagcacaaatggtctcaagggatggcgatttctcctcacatccacagggagtagaagattattctatcttggagagaattaggaaaaccctactgtgctgtgggctggtagtcctgggttctgtaagaaagcaagatcctgagcaagccatggggagcagggcagaaggcagcactcctccatgacctctgcatcagctcctgcctccaggagtctgtacgcactcgtgtgcaagtgtgtgtgtgtgtgtgtgtgtgtgtgtgtgtgtgtgtgtgtgcttgtccttacttccttcagtgaggatcagtgatgtggaaatgtaaggtaaacaaaccctttcctctccaggtggctttggtcatggtgttttcatcacaacaatgatgaccctaaaactaagacacttaccaaattcaaatactgctgttcctaggaagacagactccccgtaaagaagagtgaaggtctggtgcttgcatgtatcagtgagttaactggtaagattgaaagtcgttactctgtaccttagattcctggaacttcactttcaggtggtggaagcatcagttggctctgaaagtgaatttgccttcaggagcttcgaagtaggaggcccccaggaagggccttagaatctgtgtttccccgaggctgttttgaaaagaagggaaagtggcgcttcctgttttctttcttaaccagaggaatctgtttggtgtcagcacagaaggaaagtactttatagatgaaaggagcaagtgtggccgagacagctgctccctacagggataggacagttgtggctcttaggcccgagggacaacggtgcttcccttcaccttgtcttcctaaaactctcgttctcagatgtgaaattctaaaagtgaggtatacaacttccaaaaagcctttatcatggccagtcctgggccctctagagttctcaactctttccttgctccacgttgtctcttaagttgtgttaaattacaacgtgaagctggatttggcagtgcagcctgtaatcccagcccttgggaggcggaggcaggaggatcaggagttcaaggtcagcctagcctgagctgcataagacctgtcttaactcccctccccacataaacaaacaaaaaagaaatacatatgtttgcatctaaaactaagaaatgcatatgttcatatatattatgtggggtatggaggctttgaaatagagagagaagaaaagcacacatagtctatctacagatggttgcagtgagcttcagaccacaaagatcttctaggaagataatggtgtagctcctcctttccttcatctttagacacgcatgtgtgctcgggaggggttctgctttgtcctctctgtcctctcccccgaagggctgatattggagacactcttccacgtatgaagggttaaggacagccagctctgagttgttagttttattttcagaggaaaaacccaatgaaagtagccagttctgtgatgtgttgtaacagagcagtgttgcagtgttttgcctgtggaatggaggaggcccctctttgcccttcaccgaggtcaaaagattagatttgtgttaagaattgcaaaacttcaaaaaaaaaaattcaagccttattgacctcaaggtatgctcatgctcatgaccatgggtggacccagaagtcgggacagggcttggctcataagcaatacttgagataatttttgttttgtttttttgagacagtgtctgatgtaagtatgggagctcagattgtcataggttggcctcattatggatgttggccttgaactcctgatcaccctgccttcacctcctggggcaggcggcccatcctgctaggcttggctttaggaatggtttaatgcctttgattcttcccacgtcaatcggaggtgcgtctttgggatgacagcttctttttgatcacctgtgtttacatttagctattggaaaatgctggaagcttggtgtctgcgtgagtcacacgagggtgggaagtgtcttgcttctcagctcgtccctttctggcagttcctaggcgcaccctggtcttggactgactcagaaaaaacactcagctgctttagctttaacgaggtagcttccacccatccagctttctggaaatgcacagcttcttgagctgtaatcatgactgtgggaatcactctgcagttgtcagaggtttttctggccagggaacttctcttgccaactttttcctctaagaatatctcccttttatgtctgctcagtcaggaagagatacctgcatctcatgttcttcgctgttttgaagaaggcagcgtggttaagggaacgggaggggtaggtgcttagctccagacctagtcaccaaccacagtgctctgaagattttataggatggaaagttcctggttacttaacacttggccctgttctgtcctggcactcttcctggctgggtgattttggaggtccccttatgtcgtctctgtgtacaatatatgatgtcaaacatatggttttcccaggggtgagtcagtgtgaatctctatatcgttggtcccttgttttaacctttcttcctgtggtgtcatcaaccccatttcatcttctgcgttttgttttctttgcctttgtgagccactgaactatcggttcctaaactcagacttctgctgtcccgaggcagtgagaggtttggtgcaataaggtagcagcttgaagagcaccacagccagacagcagtgtgcatctcaggtgtggttgggtcatctgttaagttttatgtatttatagagacttatgcattacaatgttttataagccaagtcattctaatgtaagttacatatgggaattggtgttcaacaaggcaataaaatgtgtaaaataatttcagtaaacagtatttcatacccagtctgacaacagtgaggtttttcagaacctatacacttgtcttagattaagtttataggtttgcatatgtgctggctagttttatgttaccattggagaggaggaagcctcaactgagaaaaagcctctgtaagattgggttgtaggcaagcctgtagggaaatgtcaggaactcgtcggattgggtggtaggcggttaggctttgctcccttttgacacaatccaacatcccattgctaagaaagcaccatctaaagaccacacaggcgtttgtgtgcctggcagctcgtgtcaaccgtggcagtagctagcatgagggaagtgcacagatttgtatatataatcaatatacatggattgtatctctacatatgcaccgtactgcttgaccacctcctcccccatgggaatctgatctcagagaagaaaacatctgatggcctaagaagcagattcttttggtgattaaatgaccaggaaccaaagtttcatgctgtttgggtttctagtcaaagtgaatgcgatctcgatgcattggggagattctggttaataccggaatgaaaaaggatgacaaggacagctaccaccgggacacctccttttgggaggattatcatgtgtgtatctaactcacacaccctcatagtatttatggcagcactgccggccagaccccctgtagctctgcctgtgcgaggtcaggtcctgaatctgagtgagatttcccccgtgagaagaaggtgcacagtctttccctcttagaattgtcctagaaacattcgttaaaatgttccataggttcaaagtgtaattttgtaactcacgaaggaagtttttatttgtttggtgttttgagatagtgtttccctgtgtagatttggagcctgtcctggatctagctcttgtagaccaggctggtctcgaactcatagagatccgcctgcctctgcctccctagtgcctggattaaaggcgtgtgccaccaccgcccagccaggaagggatttattaacttaggtggctctctcgaatgcctgctgtgcgccaggctcctttctgaagcagagcaagcattagtgactgaaactgacaatgtgtctctaagggtttagaacgtgtcagaagtggtggctgaaggtggtcaatcctctgatcactgccaccaggtagggagtctcaccttttacagagtcacataaaaaaaaaatgagagggaaataaaagctgacactaacctgactgcttttattttttcttttggagacagggtctcattatgtagctctggctgtactggaattccctatgtagaccaggctggcctcaaactcacagagatccacctgcctctgcctccgagtgctgggattaaaggtgtgcgctatacacctggcccctgaccactcagtattttgctgtgtctcactgaaaaattttcattttatgtgtacgtgtgtactccagagtgtgtacactgtgcatgtgtgtgcaggagccggagtgtgccagaagaagcgtcaaatcagacataactggaactggagtcccagttgtgagccaccatgagggagctggggaccaaatctgggttctcttcaagagcagtcagagctttcagccactgggccatctcttcagccctcggtttctattgtgcatatctagaggtgtgtgtacgtgtactattaaattacttattctctggcaatttcagacacaaatacagatgtcacctcttcatcctcctattacccacagagtcgattagtcctgcccactaattgtgcaagagtgtggggccatctactccagcctgggcagactgctggggccacacctctgaggaaaagtgactctggtctctcagctgctatcacctgctaaaagctcttcagttaagggtggggccttgtgagcccctcccttctccatacttggaggaataatggctgacttgatctcaggcgagttattttaatatatgcatatatgtatacatacgtgctggcgaaaacatgcaggcgcacacgcgcgcacacacacacacacaagcttgctgattggtccatgcttatttttacaacatcctataggtcagggcatttcacttgcagggctttagatagctcagctgctgttggtggctgtcaaggtcaaagctgatctaacaggtttcctaccacttaatgcttcctgttcttcccacaaccagatcttttcatgaatctaggactctcaaagtttctgagtattccaactgtaaatatttacccgatgtccttgtgcagagtgaggtttctgagtgtgatgacgctaacagtgtaaacattctttccctctaggttggtggatgaccgctgtgtggtacacccagaggcaggggatcttaccaacccccccaagaagttcagaggtaagaaaagaattgagaaggagtgacttaagagggtagattattttttgtcgttaggtaaataatgttaaatggtactgagtgtgtcattcccagttcccccacagggttttgttgttgttgaactttgggggatcgctgatcaacaattatctgagttttgttttgcaatgtcacttttacacactgataagaaaccttggcggccgggcgttggtggttcatgcactcgggaggcagaggcaggcagatctctgtgagttcgaggccagcctggtctccagagcgagtgccaggataggctccaaagctacacagagaaaccctggctgaaaaaaccaaaaaaaaaaaaaaaaaaagaaaaagaaaagaaaaagaaaaaagaaagaaagacacctttaatcctaggcatgaaagatggcttttcaagccattcagtaagaactaaaggctacccatttacagatttctgtggcagtcatattacaaaagttatgatattttactggcagcttgttaattgtcttcatgaaagtcctgtgctgcatgaatgtggctttcagagtcacaccttgaggctttgtggtaactaactgttgtcatagagcttcgttccaagtgaactcttagaagtctcttcatggtctccttggctgagaaaccagttgcagcagcctgttgtttagaactcagctgctgcaaaaggattaatgggatctgcagaacattctagaaaacagaaactagtcattaaaaacatcataacaacatgcaaacattaaaagctataagagagaacttgtgatactgatctttctgagctggagtgcctcacttaatacatgtgttagttaggtttcctctttttctccctccctccttccctctttctttctttctttctttctttctttctttctttctttctttctttctttttctctctctctcctccctcccctttctctccttttctttctctctctctctctctccctcccccttccttccttccttccttccttccttccttttcaagacaaggtttctctgggtaaccaccctggctattctggcactcactctgtagaccaggctggctttgcaccaccacctgccaggctttggggagaaagggtcatattagctcacaactcttggttacactcaatcactgaaggattcagggctgggattcgaaacagaagctgatgctgaggccatggagaggtgctgcttgctccccgtggcttgctcaacctgcttttttatacaacccaggcccagctgcccaggactagcgctgctcacagtgggctggcccctcccacatcaactactaataaagataatgctcctttacaggccagtctgatggagacattttttttctcaattgtggttctctcttcccagataactgtagcttgtgtcaagtttacaaaaaacaaaacaaaaacaatgcccccaaacccaaccaggagaatataataatgtctagatccacccatttccctacaagtttcataatttcatttttgtttacaactgagtaaaattccacggtgtatatatgccgaatctcatcatccgttcatctgttgatgggtacccagactgttccatttatcagctattgtgaacacaccagcaataaacatggatgtgtacatttctctgttgtagctatagagtcctctgaacataaaatcgggagtggacagctgcacctcatggtagctttatttttattttagaaatccccatattgatttcctaatggctatacaagtttatcctcctcccagcagagaacaaggattcctctttccccaattttctcttttacaaaacttactttgttgtgtgaatgcatgcacatatgtgctcctgagtgtgccagtatgtgtcacatgtgtgctgtgcccacagagaccagaagaggtgttagatctgtggttacaggtggttctgagctgccccatgtgggtgctgggaattgaaccgagtcctttgcaagaaccgtaaatgcttttaaccactgagccatctccctagccttgccattttatttgttcttttttttttttgatcatagccattttgactcctatgagatagaatcttaaagtttccatttgcattttccttgcattggccaagtatgtcgaacgtaaaatgtttatttgtataatgatagtttgtgtttctttttttgggaactatttatttcaccagtccatttattgatggtaagttttgtttcattctctgttgtggtgatagattacttattatttactaaagcttgcatgaagattcagaaagcaaagtcagccacaagctatagagatcagatagtggggatacacacctttaatcccagcagccagaagctaggaggtggtggtacacacctttaatcctaggagtcaggattaagaggtagttgatctttgtgagtccaaggccacccagatctacacaagagtgatcccagtcctaaagagaaacagctcacaagaagatgatctcagcacctgggatcacacacctttaatcccatcactagaggggtataaaagatgggagcagggtcttcagtagtcagtatcaggcagtcattctccagccacactgaggataggaagatactgaagtcttaggattctctagccacgccgaggagaggttacagtctgcggtttggtggagccaggattgcatttcagtctgaggtagagtaagagctagtggctggctgctttgcttttctgatcttcagcttgaagtttgaaccctaatatcaatctctgggacttttactttttgtgctatactctgtgtgattgaatcttagggttactattactgtgatgaaacaccatgaccaaaagcaagctggggaagaagtttattttgcttacacttccacaaggtagttcattgttgaaggaagctagaacaggaactcaaacagggcaggaacctggaggcaggagctgatgcagaggccatgaagggagttgcttactggctcagcctgattttttatggaacacaggaccaccagcccagggatggcatcacccacaatgggctggtccctcctctatcaatcactaataccctacaggcttgcctacagccccatcttatggaagcattttcttccccccccccacctttttcaaaatttaaattagaaacaagcttgttttacatgtcaatcccagttccctccccctcccctcctcccctgccccccactaacccccatcccatcccttttctgctccccagggagggtgaggccttccataggagatcttcaaagtctgtcatataatttggagcaggacctaggccctcccccgtgtgtctaggctgagagagtgttcctctatttggagaggactctcaaagtccattcctgtactagggataaatactgatccactaccagagatcccatagattaaccagaccttcaaactgccatcctcgttcagggggtttggaacagtcccatgctggtttcccagctatcagtctggggttcatgaacaaccccttgttcaggtcagctgtttctgtgggtttctccagtctggtcttgacccctatgctcatcactcctccctctctgcaactggattccagggtttcagctcaatagttagctgtgggtgtctgcttctgggtcctctgtgatgatcctagcttgtatcaagttgacataaaactagccagcacacagttgtttatatatgctaacttccctgtctggggtatggctggtacagagtgtgcttcattctgcccattcattctgacgatggatgtctttgctgttcgaaactttaacttttcatagttccatttttccgaccttacaccgtctcatgatggttcaaagagaatagtctaaaaggcaaactgggacaaggcagtgtttgtaatagggagaggcatggatgtcagggtttaaccgcactgtctgagagctgtgtcatctaaagtgggtcacctgtcaggggcctctgagggcatctgtcactgtcccttgagagttgagctgaatagcaagaacaatgctcattgctcagggtttgcaggctcttcagtcttcccagggacagccattgcagatgaagttacattatacaaatgtataataaaaaggcataatgcatttccatcaagtgtgtttggctctatccctttacaccctaccctcttctggggcagagttttctttcattttatttttgtttctcagtcattgaattttacccatagaagatcctccccccccccaaaaaaaaacaacccagccattggatgctgtgggctgagacatccaagctctctctgggatcgtgtgatcaaacttggttcccaggggtgtcccaggtctcctgctgtgagtctcagcagccggattcccagggggattttgtgcccctcagcaggttgtgtgccagtgcagcttattctgttgaatgggaaaggttgaagctaacagctctgtgcccaagaagcaaacagattcagatgcctgggcccctgttacccagtgggcagggcttcaatgtgtcaatcaccctgagctggagcctggttttcctgtaatcagactctcggctcctctccctgctggttggcagtcagttcctgctcccactttaaagccaatctgtctctccagttttcatcagagaagggtgtccattttttccccccaaacccctgctgcatttggtcaccttgtctcattcattgtctcagggttgcaatgcttcggtgtttattgactttgcccttgatatttttggagattacagccaggcatcttattgactttcttttggcttggctctttgtgctgttttggttacagttcacttagctgggggttaaagtctggagacttacagtacagaggttatgtgtacgtctctgtatcacacaggccataatgtcaacatgatttattactagtcttgttttttgatgtataatttcacatttattgtgttaaatggagacatttactttcatttatgttatgttgactttacatttttttcttgcctatttcccttttgtatttctcccttttctggaaaaccctcctgtagaatggagttgtacaaaagtctgtgtgtgccagtgtatggtccttttcagtcaggagaagctggcttccatcagaataagaggtttacatgtctttctgtgtccctgtgggggaggaaacatagacatgatggtgaagccaaggaacctgtccccaggagggccaagtagagagaagagggttgggtttttggactagaatgttccaactcttcagattctgcaattgttgacccatgcctgtttcataacccaccaagtctgtcacagggccactcatggcaagcaacagatgtttagagatcatatgtcatggttcttcaggagctggaattcaaaggatggatttctgctctgtgcagtgaaaatagcaggtagcaaagaagaaggggcgtgggtgtgaccaaggaaaaaattttaacctgtttccttttctggtgactacaaagggtgttttgaaggcatggcctcacctttgcctccagtcatggaggttacacactcaggcacacgaatgaagacttattagtgtgtgcattcgtgctcacgcgtatatgcaagctgtgtgtgtgcatgtgtgcatgcttgtgtgcctgtgtgtgtgtgtgtgtgtgtgtgtgcatgtgtgcatgcttgtgtgcctgtgtgtgtatgtgtgtgtgtgtgtatgtgtgtgtgcatgcttgtgtgcctgtgtgtgtatgtgtgtgtgtgtgtatgtgtgtgtgcatgcttgtgtgcctgtgtgtgtatgtgtgtatgtatgtatgtgattatcagagagcccagcatgttgagttcagggcctgtctttttctttttgtacacaaagacaaacggtttcaagtttgaaatcagctaatgtaatcgattggacatttatttgatacttccatgcagcatcctgcttcgggctcccgagtcttctttattttgtcgttagagattgttgctatccagatttggggttccaaaatctgagggtaatgaggtcacacagcataaggtcactgacctttgaagcagggctgagaccagagccatggttcacatccctcccgatctttgaactttgtgttgttcttttaagttaaagacgcgtgctagatggaacaccaacacgagatacattaaccgtggagtttattacaggggggccggggaggggagcggcagggggtgaaaagagagatgatggaagagagagcaagagagagcaagagcagagagaacagtaagagagtgagagagtaggagagtaggaaagcgtaagtgggtggagtctgtctttaaaggggtcctttacacctgcgtgcagacttagtactcatggaaccctgggctgaccagagcactgcctgagtgcattctgccaggtgacaggggcagccagcataatgcctgagtccttacacgttgcttgcctggagattctgcctcgtgttcacagctgcccgagggagtcggaacctcttcctcacatcaagggtctgtttcaagggatttcctgcagctcctgtcttctgtggtcttgatatgttttaattctttttacatgccatcaactatcagtttctcagggattttctggccatcatatggtcttgttagttttctactgaggtccctgttggttagtttgacacttaacaagcaccaaggactaaacatagtacagttgactttattctggggagaagtgtagatggaagtttctgtcccacccagtccccaggccgtttagtcccaagtaaacacacagaggcttatattaattataaactgtttggcttatggttcagacttcttattggataggtctctcttaattattagcccatttccattaatctatgtatctttacatggccttggcttactagtgaagcctggtgctcttgctcccgtggcagctacatggcatctcactggtgactcactctctctcttctccttcccagaattctcctggtctggtagccctgcctatacttcctgcctggatatatcctgcctgtccattgtccaaaacagctttagtcatctacaaataagagaaacatatattcacagcacacagagggacttcccccatcagagaagccatcttggtcgtggagactacactgtagctcaagggactttctccctttgcttttccagtgaacccgaactgtgatgtaatgatttgttgctcagactgacagctgcctggatctgtattaggaccttcagcgttcttcacggggtgtcactttgactgtagatactgagcatttgcggaagtcaccctaataactgctgtctatagctaatcctctgtcactaaactcccagttggggtaataatgagtctattttccttaatgagttcactttcttcagtgatacttcagagaagagctgaagggtgaggagaagtacattccggcgcctgtttgaatctcccatggagctactcagagttacagagatcatgcattttaaaatgctggagagatggccccatggtgagagcactggccactcccagcacccacgtgacttctcacaaacagctgtaactccagtcctagggcatccaatgcccttccctgaccctgggtatcaggcacataggtggtgcacagacatgcatgaatgaggggaaaacacccataaacataaagtaaaataaatctaaagcatgcagtgttcagtaaaaggagattcttgtggttttgagtgataaggaaagggcatgaattgttgaaaaccttgcaatgagttatatgtctaagaaatgaatattgcatgaactttgattagtttgtagatttatttttgaagtttaatcgctcccctatgagtaacaagtgaggggctaacaaggtggatccgtgagtaaaggtacttgttgaacaggcttacaaccttcgtttggtccctgggatccataaaaatctggacatgtccgggcgttggtggcgcacgcctttaatcccagcacttgggaggcagaggcaggtggatctctgtgagttcaaggccagcctcagggtctacaaagtgagttctagtaccaccagggctacacagacaaagcctgtctcaaaaatcaaataaaatcaaaacaatttgtatatgctggatcacgcttgcaatccaccactcttaagaggggtgagaggcaagacaggagaactgcctggaagcatgaaggctgcttgcctggagcatactattgcagaagtgggaggtgctgccttgttaagactgacagcaagaaccagctcctgaaagttgccctctgacctccacaggtatgctgtggagtgcacaactacacgccataaagccatatcatgcacacttttacaactgacaataagtaaaaaaaaacaaactcgtgttgtaagttcgtgggtcacggtctcccttcaaactacacgggaagctattggtctaaattcctactggataaatatcatgatctgagaattttaacagctagcacggcaagtagataaaactgtgacagagagttctgggggctgctcagcagcttaaggacacttgtagaagacctgagtttggttcccagcacccacatgggaggctcacaactgcctgtaactccagctccagaggatctgacacactcttttggcctccatgaaccacccaaatgtgcataattaaaaacaaacccttttcttttttaaagatttattttgtgtatatgagtattgcctgcatgtatgtgtaccctgtgtgtatgagtatcacgcatgtgcagaggctggaagagggtgttgcatctcttggaactggagttacaggtggttgtgagtcactcaaggtaggttctaggaactgattctggatcctctgtaggaggagccagtgctctgagatggcgcccaactccaaaacaagtctttaaaaaaaggtgttacatgtggaaattctcagctttgagttcttaaaatggtcttttgtgtgtgtgccatctcacgtgatctagtattatcctatttttaccaaggtgcaggccatactttaagatgggaagtccatgctacggccgtgcagtcagttaaaagtagactgtcaacagagatcattgctacactccagacaaaccggagataaacatagttctcgaggagtttataatctaacgagggagataagaggtgtatacaaataattattagtcaaggtagaaatcgataagggctaaataaaaagctacaatgatagaggtattgtgggagatttgaaattcctgctctaagtgcagcccatgcttcttaattaggttgcatttttcttggaaggattgtccctgagggagggacacctgggatttcaggccaacaattcgacttttcatgaatgtcattaagaaactattattgctgcctacctcagaggacggctctcaggagtgtgttctctgctggctacagttactgtgtagtggtgatgactggtgtgtatggcagcgtccggatgcctccttgaactgtgatgttatccaccagccctgctgttctcttgagtgaccagagatggaagcaccaggctgtcatcactggagatatggttgggtagaggcgggggaattaaggagttcaccagacccaagataaagatgaataggtgtttttttaaagaacaacttacgcaggtaagagaaaataatggcccggtggttcctgctccaaaagatgcagtctctgttccccgagagactaaagagagtgagcaccccccttctctatcttctgcacctgaaaccacgcccaaaagggtgtggtcgctactgcaactttcactggcaaggcaagatgccactatagtcaggaacaggtgattgtaagtgattcaacaattgatgatgattaaaaaaaggctcatcagcaacaaatatttgtcaagtccttactgtatgctgattgctttatatcattaaattatttaatcctacccaatgagccttattttaatacattcttattatctgttgtttacagaaatccaaaagcctcccctttcaaaacaaccccaaaactgttccaacggctttccctggagagacaacagcgcatgtgttactctctccagaaagggaacccacagcagataaaagtaacagttgcacccgtgagtttttaattggggtgaaaggttgcttctaaggagtagggataactcaaaagcagcaacatctcaggaaagccgattctagcataggtgaccattaggagcattgtttaatcgcttttataatgttggtacaggccctaaagaatcttccaggctctaactctcttcaggtacccggacttcagtttagtcatgtttactacctgggactcctggagcaaatgtttcaatttggagagaatgttgcgatttggagaaacaggcccgatgacaccaatgacttatataggtcaaaggtttatttatctttcctttaacagttgctaggtgactgatctgggacaaattaaattaaacattttgcatagccactctaaacataccatactataagcatatttaaagagatttgttttggggctggagatattgctcagtggttaaggacacaggatgctcttccagaggacccgggttagattctgagcacccacaagcagctcagaactgtctgtaactccagtgcagggaaaccatcttctcctggtctctgagggtgccaggtgctcacatggcacacagacatatatgtgggcaacacacccattcgtaaaaataataagataattaaaaaatttaaagatttctggtgtgtgtgtgtgtctgtgagagagagagagagagagagagagagagagcacagtgtctgtggaggcccagaaaagggtgttgaagcctccggagctgtagcaacaagttgttgtgagccactcaagtgctgggaactgaacccggattttctgcaagaacagcaagtggtttttttttttttgttttgttttgttttctgagacagggtttctctgtgtagctttggagcctgtcctggcactcgctctggagacgaggctggcctcgaactcacagagatccacctgtctctgcctcctgagattaaaggtgtgcgccaccaacgcccggcatacagcaagtgtttttaacagctgagccatctctccacgacaggcaggcatattgtgaaatgttgaattggctcagttcttacattcttagcatgcataaaagtatgtccagtgtgtgtgtgtgtgggggggtgttacatacctgtttattgtcattttaaatttagattagttttgagcctttcatacatgtatattatatttacattttttcaaccttctctcttcctgcttcaacttctattgtgtccccactcgcaaattcatgacctctctttctttaaaattgctgcacaccccttctccctcatatgttgatcctctgagtgtcacttgggattgcagaacctaccagggatttatactagagaaagggattctccctttctctgcagccattaattgcctgtagctctttttctaggagtgggctttgagatatttccttcatccatgttgattttgtgagcatttcagctcggatggaattccttggcagccaggagccaaggaataccacaaagtcacgctgcacagcaaacctaacgagacagggtttctctgtgtagctttggagcctgttctggaacatgttctgtagaccaggctggcctcgaactcacagagctcctcctgcctcagtctcccggttgctgggattaaaggcgtgcaccaccacgtaattgatttagtgggagggaaaaagccaggagggtgactgcttctgctcgggcaagaaacagcagcaaactgatcaggatgcagggcttatgtacagtttcttgggaaggggtgaacttttcagggtggagctttccttgtggagagtgatgggatttcatgtccagacattcggtttttaactctgtagggcaggggcagggtccagaagttagggcacttagagtgttctgtgggtgggacctggcagttagaggccttgggggaggggcttacagacatatcattcggagttgtcattatgctggtctcttttagcaacatattgctgggagttcaggggggcatcttccctgctgtgtctagatggtgttatctagcagcaggtactctggttcttgggctgttgtaatctttctgccttttgctgcttttcctggacttaggtgtagtggttgctttgcagatacatcagtcggattaggttggtcacttctctgctgtttgagcagttgtggttttctgtgatgatctttgtcttctacaaaagaggcttccttgacgagaggtgagagctgcacttaactgggagtttaaggataagagttcagaatacagttagcaattacatggtggtagtgggttttcctctggggtgtgggatctctccactcattggtagttggctaggtttagagtaccagacatgagttatttcttgttgaataggactaaagtcaagtttgacaggtgttggttacccccaagataacaatgccactatggcacccctggggagatcttaccaggacagtcacaagcgtggtttgtaggctctacagctaggtaggattattgatccttttttcctccctcggcagcttgcacagctccttctgataccatgagagctagtcctcaaggaggaggcttccgagtcagttcagtttcattctcccaagtttggtgttggaagtatatggtgtcttcagtcatagggcctgcccttcaaccagggacaatgacaatagcctgtgctgtttggggagactcttggacaaagcactattttaagtggaaatacgcacagactaggctggtcctgaggtaggtgtaccttgggtctccccctcctgagtattaaaaagactaaaagtcctgtttcatgtgtgaagtccaggtatctccctgaaatagcacaatctttactgttcttttgagttagtaagacattctaggtgagagattgatttctgactcgtgtattccagatcccagtcgactgccttcctccttaggtgttgactcagtgacccagtggtttcaaggtcctctgatcaggcgctcttgtttatagtctgtggttttcatggcaaatacagcaatttcagaagaaagcaaacagtgctggcgggtggtgatgtttgttttgcaaacgcttggaagcggtttggaagccgtcttccaaagaagaaggtgcataataacctcacaaagcctctctctctcttcagccgctgaaatccagtctcagctggctgcgcaccacccgaggtggttacacttttgcttgcagagagcagtgcaacactagaacactggaagaagataagccgacctggggagtgtcctgtcctagaatcacagtgttagacccctggaaaactcaggtatccggggtcccaggccacgactgcggtcaccccaatcaccaggtggatttgagagcttgctgcaaactgcatgaggctttattgtaatttaacgagctaaccccatgttagctcgggtctttcacccatacgccgtgggcggatggctagaaaagacagctcatagggcctcccaagagatcttatagggcagcgtaaggggagtgtctaggggtaagcacaggctcaggattggtgtgcctccaggcctggagggcttgccctgtgttgattggcccataactggttgttatggcccataggccctcccagggtggttgctatgctttgtgcgtcattgctgtgcgcttgtccgtaaagcacacccagagccataaagcatagctccaccagctaaattctgaggggttccttgtcacgagacaggcatctgactttctagtgactaactaacttctgattggttccttgtcacaaggcaggcatctgacctctaagtgaccaaggcaagtttatggcaagcacgtgttcggctgttatggctgctgaaaggggagctggtcccttcaacagatgggctgaagatggtgttttagggtagcatttgagtcattgtgtagttgtactgctttttgtagggagtccttcatgaagtctgggacagccttctgctccaaagaagtttcctgttaagcaatttgaactctgattgtatctgcataatgaaatgcccagatgtgggaaaattttggaagagacatagttgaagagagttggttttgtggctaggttctgaagtgtggttgtagacaaagaacatccaaatccttcaaaaggcacactgaaaaaacaaacaaagccagctgttatggctgtccccgtgtggacaccacactggggctgatattttggtgtaaaacattagcaaaaaggattttagtatctattgttactgtatttttgtgtatgtgactgtatatagtgtgggcatatgtgtgtattcctaggtatgttaattggtgtgtatgcaactctgtgggagtgtgtacaatggggtgtcacagccagagggcaacactgagtatcttcctccttcacactccaccttatattaaaaataatttaaatgtgttccgtggcacatgtgtggaggtcagaggacaactctgtgaagttgtttttctcccttatctgtgtatggcttctggggctctaactcgggttatcaggcttgcatcttagggcggccagcaccttcacctgaacctggagcttgctattcagcttggctgaccagtgagccccagggatcctcctgtctctgccctctcagccttgggattttaagtgtgtgccttttgctgtgcctagctttctattctttattttttctttctattctttttttttaagtgctgagaatctgttcttaatgcttgtaaggtaatgttttagctagctgaaccatcacttaactcctaattcctattcccaattacagtttctcccagtattaagaaagttaaagatgcaaccaagtgatggtggcacagggctataatcccagcggatctctgagtttgaggccagcctggtctccagagcgagtgcaaggataggctccaaagctacacagagaaaccctgtcttgaaaaaccaagaaaaaaaaaagataaaataaagttaaaggcgtgtaggtacctgaaccaatagagaaagtagtttcctactttcacccttacatggaggatgggcagctgtgcctaccgggctttccctgatggcctctctttgcctttctcagtaagtctgttaaaaagcccaggttccaaggagcctagaaatgctgtctttgctaaccaaagttttggtacattgtcaggtttttgcttaaattagaaataaaggagtgcaagatgagacatgagtctaagagacattgtaaccagtttattatatcatggagagcgagtgagagagaaatagaagagagaagaggcggagagagaagagaagcaaagagaacagagggaagagagcctacgtgggcagggtctgtctcttaaaggggtcctctacacctgtgtgcagacttagtttccatggaaccctgggctgaccagggcactgcctgagtggatcctgccaggtaataggggcaggccagtataatgcctgaacctttcaaagtagaaagtggagaaaacactggcaacccagagaatttactgcatatgccctgtgtatttgctggtgtagtgtactgcagccaggcagcaggccatgacctgaactaggtgacaggaagaggtgtggactgggtacccctgtggcttctctgggtcttttgagaggaggctatacaagatccaactatactcataacaactctaacgtgttattggctttcttgagttttgttctttcctgttcatacagtatcttcgggagctacatgacatggctttgtctggtggttgaaacttcaataccctcttcatggaggagaggaaggcaggggatgtaggcactttggtgggggggggggatccgtgattctcagggggcatgatcagggatggagtccgtacagcactcctctggattctggtttagttttaattcccgtcctctctgacagagttagatttttcttgggtaatgaaatttcatccagatgactaaaggcagttatagtcacccgaccccctgttctgtcccctgagggaattcggtagaagcctctcgctgtgcttaggagaaggagtaggggagaaccaaggcaaggggaaggctggagactgcagtctgctacgcctgcttcagctgggcacatcacagcaccacatctgggggtgtcattatctgagtcctgacacacttcctgaagtgctgagcctggctttagtttatctgtatcccttatgtgaaactaagttctaggttctcttggttgctacattgtttgccttctttactcagacttggcttggatttattgaaagtgattggcagtaggttacacaccttgctctgcccaaagctactctttcagtgttcaccacctttagtcagtctttgtaggaatgctgtctgtcacctgctagcttgtgggcaggtaccagcgcacagtgtcagtctgtgtttcatttgtctaaatttgcctgttgtttgtgaaaccacttttaattttcttaggcaagatacaattttacaatcgaaattgaatccgacctcagtatttaaatagcagctgtggagggaaggccaacagttacaaatggctctttgccttcctttgaaagggagcctttctgtggggaaatgccttgcctggccaccctgggctaatttacatggaaaaagggaaacacaggattcatttgaatttggtgcataaattatatccttgccagacaaatgtgaagggacaaatttcagcatttctcagacaggacattcttaccacaagttagttaatataatgaatatggcccagtcaccgccatctggtcagaagtggatatttttttggttgtttttttttttttttttctgtagcatttaccgatttacttgagactcactttgatagacactgggttagtcagaggtagatggccttcctgttgtaaatcagcaggagaatccacattggtctggacctcaatcctggagaagaccctgccagtttgtattctttaccgaggcttcaccggggcaacataaactctctgaaagactatttaagctttacaattatgttcctgttgccaccaagtagaaaataagagcaaatgcgtggttttatgctgcgctcatgcctgtgctgtaaggtttgtttcttttgggatctcagttctgcacagcatcctcttgtgactaaggaatgatttgttccttttccatgaggagcagctccctgttttgctagggttgacttgactctgagctctgcatcctgggggagaatctacctctaagtctcaaggttcagcattactccctgactcatccttcacattgccatggtgcttccttacagtgacatctttcagacacccggagactttccagatatgtttgaggcccggagagtttcacaggtgttgttagcaaggacatttgactctattgatttgcatggctttataggtcaagagaacagggaaccattttttttcaggttgctgcaggcctcttacaggacaggaaatgctaattttatttgatcctaggagaacatagaaatgcctttgctagttcaggtacccagctctagctagggagccgggaccactgaggaatgcctgtgcaggctgctgcaggtgaaatgacctcggaggaaactaccaggcctgctactctgtcctgcctgggcgcctccctccttccatccctccctccctccccctctccctctccctctcctccttcccctccctgtgtcatcctccctttcttcttctcttctccttttttttcttcctctgtagaccagcctggtcttgaactcacagagccacctgcttcagcctcacaagttcttatagtatcaattcctattaaactcttaacatgttcagtgtctggtgaaggcagaaagaagacgagcagggggtgatgggatatgagaaagtgtggcagagctgggaagagaccaatcagagaacaaggcaggatccaggcgagggagcagctgcaggacaaggagcctggagagaggagcgcacgctgggtttttaatttgggcacttttcttttaaatcatattttagctaacatcactatccctgggattacaatgaatagaagcaaatactcctagccctctcagaactgcctttgagcttccagtctgccttagccgggagagtctgagctgccagccatccactctggctttcacgtctcccgtgttcccagaggttgttctcatgaggtctctgcctaaaacattgtcacagcaccaggtgcctctgataaattttatcagataggcagaggaagagtaacagttgtgctaagcacacatgttccggattcaaagacttatgtgcctccaagagagtcagctaagcattccccaaactgacacggcacagctgagatgactcaggctcaagctttgtggcagcattattaatttctagggtgcttaaaattaagacaagttttaaaattaatttattttttgagatagggtctcaaaaaatgtttttttctggttgtcctggagctttctatgaagactaagccatactcaaatgcacagagactcacctgcctctgcctccccagtgctgggattaaagtgttcactaccacacctggcctaggagattttagatgcctactatgaaattttaaaatgctaaaaaaatttaaattagatttacttatttggtgcatgtgcttgcacacgcctgacacatgcgtggacgtcagagatcaatttatggcagtcacactctcccaccatgtggggtccatgacttgaactcaggtcctcaggctttgtagccagtgtttttacccactgaactatctccacagtttctaattgtttcccttgaaggagtctggggcaacccactggggatcctctgtgttgccacgagccgttattccactctttgataaaaccttgctttccttcgctgcaaaagaacctgcttacccatatagtgtgctattactaccacaaatgcacagaccttcagctagacacacagctctgtaattgtgagggagtctgcatgtgcttgggataattttatgtctgggttttggacatttgaaacttctggtatgaggtgatgtgcttgacatttcaaggctggttggcctgagccgatggaagtttattatgaaaacatggggaagggaaggaagacagaagccagctttggtcacactgcctgggcctcatggctacagcactgtgtgtgagtagcgagaccggtcctgtggatgccacagcaaccattaaaactgctcccgcagagatgactcgccactgctttgaactctgagacacagtcatctttccacctatttgagttgatgtcctatcacaaaaaagcgagtgttaactttccgtgcgggaggcatgaccaaatatctattcgggccagatggtgcaccaaagatagacaaagaaatgatcccacccaagcccagcacagttcaccgatgagttcagcaggtttgctgttgggagcatggctgacccccaaacatctgcaccaccaccaagtccccctctggcatgtgtggtgagttctgcaaggctgcatctgcattgactcccccccctccccccgtagttacccttccagctgccagcacctcccaacatcacatacagcagaggctgaggtatacacagtgagggtgcagcagggagcgctgggtctcagctgcgggtgcagtgcacttcctcatccattccaggagggaacatccacaatcctcagggatggggttcttgtaggtcatcatggcagctgtgactaagatggcgaaggctgccctccttagatgatggcacgccacacacagccagccacgcgattgtgttctgcacaggttccaataataccgaactgtacacatttgcatcatacacaaaagaattaaggatagagaagtaaacatagcataaatactttttttttctagtattttctttgatagtcccccagaatgcgcacctttttgagagccttctgtcacagtgtttgctgtcattatgactcaactgtttttgctgcttgggtgatgtcagctggctgcgtgatcatgggcagatagcctcatttaactcacttctaaagtgaggtaattatgtgtgttttgtagaactgctttggagattgaactcaacaagatgtttaaagctcttagggtaatggctggcctgctggctgtcccccctcaggtgtgaactgctttctgttctcctcaacctccctcctgctcatgtaaggtgtctactttctgctcttctgccccggggcttggcttactgccctgtttctgccggctgtcttctgagctctcttgtgtagacagagcatccagttaagtttattggttgtgtctgtctatcccatttccctggaacaatcctgacttggaccgtggtcgcagtgcagttggcatagctctttcatgttgtcaaggatgtagttttggaaacaaaggttatccttcgtaagaccaccatgggcccgtgtgagaaggtggactccttgtgtgacgactctctccctccttggcactgcatgcctagagcaaccgtctgcagatgacacagtgacaagtgacgtattgactgcaggaaatgatgggacgatagggtcggcgagcatggctcagagggatttccagctctgccatccagggacacagagcccacactttagatgaggcctgggcagttggatcctataaccagggtgactgtctatacagatgcaagagtgaaaggcaagaatgtttcaaacattgaaacatgtttagcttggaaatctaagtctctgacctgaagctcaaattcatgatcaattttttcctgattcgagaaaatcttctcctaattcgggagcgctgacacaccagaccctacccagtgttgacagcagtagttagaaataggtcttgccaaatggggaacctgcctaagaccgaactagatttcctttatataggtgacaatgttgcgaatgggacaatatatgaggccactggcagagggtccaagatctaacactaatgcacagactgacttaggtgagcccattctatatggagagatgccttgcccagcctagacacaggggtgtggggggtggagaggtgccttggtcctgcctcaatgagatgatgggacagacttagtagacttcctaggggaggcctcactctctccatggagcaggtgggaggaggggggagtgcagggcttgagaggaaaggagggagggggaactgggattggaatgtaaaaaattaattaaaaaatgaacaaaaaatagactaagattaaaaggtagaaagtagaaaaaaaaaaaaagaaataggtcttgctctgtaagaggctggagagcagtggttctcaaccttcctaatgctgtgaccctccaatccagttcttcatgttgcagtgacccccaaccgtcaaatcattttcattgccactttgtagctgtaactttgctattgttaggaatcatagtgtaatattttcttttggagatagaagtttgccaaagaggttgtgacccacagtttgagaacaactgtgtgtgtgagtgtgtgtgtgtgtgtgtgtgtgtgtgtgtgtgtgtgtgagagagagagagagagagagagagagagagagagagagagagagacagagagagacagagagagacagagacagagacagagacagagagagacaggaatcatttcttattctcatggtgtctcacctaagtctattgttcttcacgtggtgaattttctgtttttctccacttttcatccctttggacaccaagtcgatactgaatagcggatgtaaagatcccgtgacagtgctggggaaattccatgtgattcatgagttatgacatcatgctgaggcagataacttaaaattactcttttctttatgaagtcgtagaagacaaggctgtaattaaaaatagagcattaatgcttttgatattttcctcaaaatgcttatcatgacgtgtgcatgatccatgtgggcacacgcatgccagttgactctctccttcccgtgctgcttctggggatcaggctctcgctgcaaactccttttccccctgcacccttccttatacattaattttaattaacactcaacatgatgactctcattatgacagtcttatggatgaatatcatattctggttatattcagctcctcgcatgtttattttgtcttttgagatggtctcacagtgtagcaggctgacctcaaactaagggtcctccttcatcagccgtttgagtgctggggttatagcgtgtgccactagactggcaggtgtttggttttagtactactttcaggacattagccagaattgttaccattgagaaaaagaaaaaagcccacccaaacaattagatgttagtcctagcattattattattattattattattattattattattattattttgaggtttattattattttgaggtagcaagactttaatttcgaatgtgaatgtactgtttggttgtgctgttcatgcctgcaacactcttaactcagggaaagcaagagttcctgtgttctcaagattcaggagcagatctaaggctgtgcttgtagctcagtggtagagtgcttgcccaacactcaaaaggtcctgggttcagttcccagcactgcaggaaaagaatgaggaccaggggagagatgctctataattaatgtcttggtgtccctttgcttgctcagaaggaaacacagcaattggaactcattagaggagtttgacggtctcgactgaaaagccaccaagtttggcttctcagcagcacctggcattgtccgtcatggaatgagcaggggctttcccctagtctctaaggtctagagctttgtgggtaataatctgagtgactgtggctttggaccactgtccattttcagctctcacttgagcatttaaagtcagtgctaaccaatggtaagtccactttgtgtagctcccctgtggatttcaccgccacactgcagtgcaaacatttaatagagggtctaggagctggctcagggggtagagtgcttgctgtgtgagtgtgagggcccgagttcaatccctcgggcatggtgtgtgcatgcgattctgttgaaatggagacaggtgatcctgtggagactgacgaccagctgaattggcaaaccccaggacagtgtctcgaaaccaaagtgtataatgattgtgacaccccaggttggcccccacatgcctgcacacacatgcatccgcacacgcatagacggtttcaacggtgtcttggctggtggactccgaggtttgcctgagtttttcatttgttccatcatatatgtttcatggtccccaggaactcaaaagccaaataagcttcttggtctccccagcattgtgtcactgctgaggagtgtgggctcctgggaggaagcttgttcagatactaggggtggtcatggcatctgtaagtgtgaaagcagggtctgtctcacgtgagaaatgggacacccagtggacagttctgcagacagctggggagccacaatcctgaggctttcctgacaagctgggtgagaggcaccttcctgaagtttaggtgggaatgactgtcacccagagaggtaattcctgtgtagtcatttccgaagattaagaacacttgctctggctggaaggacctgtattggtagaaggttagtaggcctgctgaagacccgtggaaggagtgagtcatgttgagagagcctgttgaagaataataactaaaaaaaaaagttaatgaaagattagtatgagggaggatacccaacacgggtcactcaacaaaaggcaaaggggggtgagttagaatcggatgcaagaggaaatattaaagccagtgttggaagagatgggcccggtggtggtagagcgggattggagtgggatggtgtgagaggtggaggtgagttaagcagagactttacttgtcctgtgacagttagcaaacagagaatggagcctaaagacaaaacaagggacctccatggacctgagtagaatttatagcatttgcatgcacattgtgaaggcacaaagatgatgagggttgactccatcaggttactaatatttctgaagtctaggagtgtggtagattatggcttttttttttttcattgagaccttgttggaatggattaactactttggaaaaatgataatctctctagtgaggaacctggaacatcaggggtcacagtcatagcaggtcacacaaagtcttaggggctcatggcacatacagagctctgggctggcagcagtgtgatatgttattaagagcaaggagacacggaggaagaggaagaggaggaggagggagggttgaggggtaggagagaagagaagagtaataagaacagtggggaaggaagcgagcaggcaagtctaacgaattactttcctttctaattttaagtgcctgcttctgtgtataaccgagagcttcagataaaacaaagtgtccttgtgtggtgcttaagattgtccctcagaccgcttggccctagctgctgattgctgctttgatttacctgggtatttagcaaggtgtgtttctgggagtttgaaagggaagctgggggtgtcttttgcttactacgatactcattttcatgtaaccactcagagaattagagcaaaattaattaggaagctaaacaaaataatgttccccaacacacacacacacaaatccacacacacacacacacacacacacacacacacacacatgcaagcttgagctcttggagagaaggcaaatttatacagcaatgcacaattttgccacacccagttttgggtcactttgtggacaccgagtttctctcatgtatgtgcatttaactgaggagcataaattagctgtgaatgaccccagtgtggtaagtgaccaagcgtgggggtctgccaagccaagtctgtgaatctcttggcaagctagggacaacacaactggctgggtgataccacccacagacaagaaccctcaggagttgtcaggactgtttccacagaggcacctactatgccatgacccagagcaatgcagggagcagtttccagcttccaggaggcaaattaccagggtggtcttcgcttatttcttgtgcaaaggcacaggggcttcctgggccccaaggagaacactgctgctctctgaaagtgggattcagggagagaatgtgctcgtttgaatgcacagtgcaagcaggctgcagagaaacggctctgggagccatggcagagcatcccctgcttgggtgcactgtgcgtatgtgtgtgtgcgtgtgtaatgtatgcatacaagtatgcgtgtgtgcaaaatgtgtattgtgcacagtgtgtgtttgcatgcatgtacactctgtttgtgtgtgtgcacagtaggtgtgcatatgtatgtgcacagtatgtttgtcagtgtgtatgcatatagtgtatgtgctgtgggaaccttgcattttgagcttttttaatccacttggagtcccctgtttagattctttggggttaatcagaaatttaatgtgctgtttatgaatttggggtgcacatcatctagttagggagttaagagtcaacgtagaaaataaagaccaacaggatggtttgtatctgtagatggatagtatatatgacaggggaccaagaaagggattcctgtgtggtcatgtagtcagggaagcctcctggaagagtagaaattaggtttgtgaaataagttctttctcattctctgtctctgtctctctctctcccaactttctggagacagtgtctcacgccgtatctcaggctgactttgaactcactgtgtaatgcaggctggactcaaatgcatgaccatcctcttgcctcagcttcccaagggctgggatcacaggtgtgtgtcatcatggccagctggagttaaactttaatggaaatgtcagttattgaacatttgcggtctttgtgtctagaaactggattcagatttgggttgagtgagacctctgggaagctgtggacactctctgttaattgtgttcctgggaaacagtccacccaccctttctttttctctctgaaatgacatgttcttgtgtgtacacggatgtacaggtgctcaagtctgtttgtgcacatgtagagaccagagccagatatgggatgcctttctctaactcctcattatttccttgagacaagctctctccccaaccggaaattcccgctgcctcagcttggttagcagcccagcaagctctctggatgctgctttctcactgcccatgccggttacaggcttgtgcagccatgaccagctttcatgtgggggtggggtttgaactcaggtcttcatgagtgcacatcaggcgactcactttcccagatccccaaatgaattgttctaaaattttgctttttttttttttttccagtttgatccccctatagacttctgtaattgaggaattggtgcttccaggatggcgccaaagagcccttcttcaaacaatggaagtcagcccccttgctagcaatttttctaacaagctgactgttggatttgcagtttagaaaatgaatctgtagcttctactagattatcagccccaggattcagataaacaaactttccagctcaaggtggggcggctttcctcttctgtctggaatcagtcacacagaaggggaacgtggcatctaaccattaggggccccgactctcagctgagcagctactgctccaggagatcacacctgctctctgcctgtgtttgttcagggataaaaggagagaagcccaggggctcctgtgttttcatccagcagcctagggcctgcggtttctcattctccacgaatgagcctgctggtgcaggcaaagctgttgctaaccactgggcaggataggcctccgtgacctggagaacacacacactgctcctgcctggggtgtttctccattgaaaagccatttcatatgaagaaagttacacctattgctgctggcatagcttaaggttaaacttaattaattagtgtgtgtgtgtgtgtgtgtgtgtgtgtgtgtgtgatatgcattcctcagcatttgtgtggaagtcagagggtaagtttcaggagatcaaactcaggttgtgaggcttggtgacaagcctgttacccactgagccatctcactggcccagttggcctaacttttaacttgtgatgatctataaataagtaattgcctgtagaatcattttcttctgtatttcccatttttgtctgttgtatttttacctttttttttttttgagacatgttctcgtgtagactaggttagctttaaactcactgtgtagctgaggctggccttgaactcttgaccctcctgcctttgccttccatgtgccagaattacaggagtgtaatgccaggcctagccacattttttctttgcaaagctcctaacagccaccttaaaacggcaaggcagtcaccatcaacaacaacaaagatcatttctcttgggagaatcaggcgttgttattgtcacacagaacagtgtccagttctgtgagctgctgccatccagcacatggccaggattttcatcttggttcatctgtggcctctgtctcttacgcctcattcaaaatggacaaaacccctataggttttcccttttaaaatgtacatagtgctttctgcccagatctctggcgtggctctaggtctgcccagtgattctgatctccggcgtggctctgtgaccagtgcctcctctcttgtgtaatcctcccaacatatccttgtcttgactgtcctctctctgcagtcagtggaatgagcatgctaggacagaagttggggtacactatcaatgtctccatctcgctgtgagtgacatccagtgtccccattggcccccatgaccctgtgtaaactggctgggcctctgctttgtggcctctctgccatgatctggccactcaggggcccaccagttatgcctgtctacttctgttactgtcactcaccctcttcaggggccttcggggtctgttcacctctttggtgctccaagatgtcagcagcctctgttcaaatnnnnnnnnnnnnnnnttggtttttttacctccctccttcctccccccctccctccctccctccctccctccctccctctctctctccctccttctctctctctttcctgcctcagctgggattaaaggcatgcaccatcgtgatgagcttgagtgtccatgaacaactgaacgaaagattgaaagtattcacttgtgaatacaggatgaaatgtcacaggctccagttcaatttaaaggctttatcgtagatatgtattatatttgatcataatcagggtgtagagaatatgctcgtagtatctggtgccacaactggattctactcaagatttgtctaaaataaatggaaacaagaaaacacagtgctaatgtatgcaggcttggtttggtgggtgtacgcttataaccccagcatggaggaggtagagacaggatccccgtgagtttgaggccagactggtctacagtttacacacacacacgcacgcacgcacgcacgcacgcacgcatgcacacacacacacacacacacacacacacacacacacactacaatagaatgagaatgctgtgaaccaaaatttctttaatgataattcagtgagggccagggagatgactcagtggataaattacatgagacacaaagggagagagacctgagttcagatccccagagcccaggtaaaaagtcaggctgctgtgacagccaactttaactgtcagttcaacacagcctgaagtcgcctgtaaaggaatctcaatccccatcaggttggcctgtgggcatatctgcagggttttcctgattattgatggatgtaagaagacccagtccactgtgggtggctccattccctggacaggcggccctgggctctataaggaagccagttaagcatcatttcttcatagtttctggactgtaacctgtgggctaaaataaacccttttcctccctaggttgcttttggtgatggtgtttgtctcaaccagagaaaggaaccaagaacaccaggtgttccaggctgttctccccccaaattaaatggtggctccagcttcaaatttgtttcatgctgtgtttaggaaagtttatctcaggaaacttagccagatttacctgctgcgcccagggagtgtcttatcagccagccatcaaatactttggaaagctacactgtacagggagatctctagatcctgccaggcagcaggcaactgccccagtgttcccagcctgcttaccaggcaaccacaaacaaaacaggcagaggaaagctgcgtggctttgaaagcgtggtttctgtcttaggagcgtttgagaagcagctgatccatagagagcaggcactccagggtcaggtacagctatggccattaaaaaattaaaacagcaaacaaaccagtaatttatttactattcactcattttaagtgtttactccaaggaatgttggtaaattcagtgagcagtgagcaccgcagctgctcttccatcaaagggttcctccttccatccatgtgccattaccttcccgaacgtacagaacagctggacgcagtctttgcatcatctcctgctcacaaggacacagctggtgaggctgcctgtttgggttcgagtcttagcagtgccactttctggctctgggttaggctctaatctttaaacagggtctcatgatctgcaaaatgacagcagcgttgacgtctgctaaagaaatttccatgggttaaataatctatcgagtgtttatccgtgaaccatgtagaagctgctgggtgttggggaggcgcagtcttgaccgttcctcccaccctccaaagctgtcattcgttttaattttaaccattctgatgtgctttcagtcacatttccctaaaggccacgggtactggatatctcaaagtttcttattacatttctctctctctctctctctctctctctctctctctctctctgtgtgtgtgtgtgtgtgtgtgtgtgtgtgtgtatgtgtgctaaaagggaatatatatgcacagcatgtgtgtggcggtcaagacagcttgtgagagttggttctccctttctgccaagcgggcccaggccatgaggcctgaggcaagtgcctttacctgacaagccatccccaagcagcagcttttttgatatttgtttttattatttttaattatttataggtgtgtgtgtgtctgcatgtgggtgtgtgcatgtgagtccagacaccgttggaggccagaggtgttggaggccatggagctggtgttacagatggttgtgagccacctgatgtacatgctgggaactgaacttggttatctcttcgtctcttctggatgttttaaaatcatttacacatgttttaaacatcgtttaaaatgcttcttgccttcccttattttatgagtgtggtgcacggtctcatggcaccctgctttagaaaccccaggacacaaacacaactgtatttgttcatctgcaaggcaagttgggctaataataatgagtagtgacattgcccgaactgtgagtgttttaacctcataccaacacacactcagtggtagaaaacgcaggagactccagggctgggccttcctggttccagaatgttggcaagtcaaagcaaactgcagtttagtgaccacaacagagacaggcgagtggtggggactctgtgggtgcaggggcgagccctgtcctcttcgtgccaacctcctgaaaaccaggaagtgttcagacctcttcccgacacagatcccttctgctcgttgcttgtcccagcttgaggaataagtttgcctgcctgtgagtaattcacagtttcggctttgtcccccagttgttggcaaggttccctgatgctgaactaagctttgctttgatcctggatcaatcactatagggaaataaatcgcccctccctgctttagactggcagctgctcatttctgtgaaatgtgtttatatacctttccattttctagaatgcaacattttcaagtttttactgaagttccccagctaccacggctgttgtgcttgtgttacgatgcctgcagccccaggtacaagctcctttgttaggaagtcacttaaagtgtgactcctacagtggtggtccttttccttctgtgagggaccattcattcatcgaccagccccaaattgtggccccggcttttcagcaactccactactgtgtctatgaggtattagggtgattgcatatgtgtaattcaaactagatcacttgagaaaggaacgggggatgatttactatcaggcccaggcagctggaataagtcagtaatttcttaagcttgtccatggagtcttgggtatacagggctatataatcactgtatcaattttctgttgttctgacaaaatacctcaggctgcaaacttataaaaaaggggggcttatttagctcccactatttgaggtctaaggacatggtacagcctggctgtgttgaggactccgtttactacatcatgtgatgacgatgagagattttatagcgagacgggcagtagagggtagggggttccacaagagcgaccttcatctccttttgaggaagcatccccaatgacctaattgccttccactaaactccaccccttgaaggtgtcaccacctgtgagcctggccaagttccccacaagagtgctaggaccctagatgagccacgtccaagcacagagtcactctgattatgttacatttgtattttaagaactagtgatttgtacccgtcctctgtgccccctgtgttgtacctgagtgcttgggttttgtttccttactgtggtttttatgtttttgtaaagcttgactgttggtgaaagtacaaggaagtctagatttttatgtgtcagaaaacttgatgagcaactattctgcatatttctgtcatcatgggtggtctaaagggtgcctctctgggatcctcattcccaaccctcttcacttcctgggtgccaggctttggaggtaaaacaagaacagagattgtcaactagttctactgttgtgctctaaaatgtcacagaagagcaaggacgaacttctgatgactgctccttcggaagcttcgtggcagccttctgtttgcaaaaaggttctgactgcctgcacattgcaggcaggtgctaaacacagactcatacgcagacttgctgacgagtgaaggtagctggtggacactgctgtaggaaaggacaggcagaacgagcagaggaggaggaggcatttaaaggtttatttttatctttatgcatatgaagtgtgcatgtatgtgtgtgtgtaccatgcgtgtacagtgcccacagaggtcagaagagggcatcgagtcttctagaactggaggcacagatggttgtgagctgttctgtaggtgttgggacctgaacctagtcctctgcaagagcagcaatcactcataaccactgagcaatcgctccagtcccactgaacactattgcgactttcagaagtaaatgtgttttgtattgtaaccctgcgcaatgcatgtgtgtacacatgtgtgtaaccctgcgaaatgcatgtgtgtacacgttacagtacatggatgcatttctcaagagtggtgcagtggtgctcctgctcccctttccctgttcttcctgctccatttggttccactcagtcggatcttttccatcccattcagaggggatattaggatggaatggattgtttgattttgccatagacgatacatgcacacatacgcacacacacacataccacaccacacacacacacacacacaccacataccacataccacacaccacacacacacacacacacacaccacacacacaccacaccacacacacacatacacaccacacacacaccacacacaccacacaccacacacacaccacacaccacacaccacacacacacagtacacacacacacacaccacacaccacacacacaccacacacaccacacaccacacacacacacacacatcatacacaccaaacacacacagtacacacacacacacacacacacacacacacacaccacacaattatataagtatcacgtatggatgcatgcatataaattgtttcctttcttctcttttggctcttgggtttgtttaatgaaatttagagatgtgcatttgattcctgaaatcaattcatccattacacatttttttataaatcaccattgtgaacatgtcatatctatagtgggaaagctaagtgaaaaacattattcattgtgttttttcccccaatttcaaatgctgcttatccattgaaatggtctattgaatgttagaatccaaaccttaaccagaatataaattattcataatctatttctcttcttatccaaatgaagctttgtttctaagtatttactcattaacatttgaaccaggaaattaatctcaagaagaatacgattttgtaacattctcattgatgtatttacccttattttagtacattaacaaaatccccctaaaaacattcatcagtttcttttgatgtatgatatctattgaacatacgtgtgtataaatgtgaacatattccacagtttttatctagaagttatctgtgtgcacggctttagtaggatggatgagaagcgagccatcccttgctgtctggccagtatttttccactgtttatacttgctggtcacattaaggctttgctgttaattgaacagtcacatctattgtggtgacactaggacctggatctttctgtgatgatgaaggaaagtttaagtgcagaattccgaaggactctgtttggggacacgaggtttgtggtggaagctggtttcaactggttctgagtgacctcaagatgcacatgtagagttaagaacaacgtttgacgtgaggcactttgcttcaacatgaaaaaaacgtgtgtgagtaattgctttgactcatagctgcatagtgaattgggcttggaggccctggttcaaattccagatcaactccttagcccctttgtgggtttaagaactgcgttttcatttctgtaaccctgactgactctcaagagggaagagaaaacgctgtttgttgccagtttgtagcactttttactgtttacacagtgtttgctgatagtcaactgtgttgagggaacaaatgtgacaggaatgtctttactgtcaaggtcagtgctgtagtttggatctggaatgccacccccacaaacccggacccatgtatggaaagcttggtccccagactgtggctctactgtgaggtagagaagactccatggtggggcctagccaaaaagttaggtgctggtcttctatggaagggcggcttcccgccctccccgcccttctctttgcttgctttctgtgaggtaagtggttccctccatcacattgttgccaccatgatttactgtggcaccacaggtccaaaggcagcaggacctgtacttatcattaacttaattatctcaggtattctgtcacggtaatggaacggaaagttacctgatacaagcagtcatttgccagggcactctaggtactgtgtgtggttgctcttgtccatacgtgtaatgtgttctaatctggagagtcttatcaggaagaaccttgacaactcaggctctgaggttttgctcctttatctcagagaacagaaggctggattttatctgagtcccctttgaggcttaacactttagcattgcacagcccggagctatggaagacggtttctcttcccttccgcagtaagggctctgtgatggaggaaggagattgctgttttcatgggtgctggcctaagatgtgttgtgatgaacttttcgtgtttcttaatgcaggccgaccattcctcctgacctttgcagcctccttaggcaggtccaagggagagatttggtttgatatttccaaaagaacatactctctctgataacttctcaacattgagagtctgatacagacagtgcattttaaaacgagttccttagactgaagtaaaagccaagttacatacagctctgttgcagaccatcccacgaccagctcagactaccccacggccaggtcagagatgagtcgctgctgtggactggccacttgtcttcctgcctgcttcccaaggaagtgctctaacaacttcattcctcatgggcaaggccactggactcggctgtgtccccttccaaagaggagagcattcccagaaccttaccttacacaccttcctccccaagcagggagtgaaatctctggcagcaacgttccctagttggcatgaggtcattctacaaggtggacgtccgacttgctgaaagacaggcttgctgatgggttaatgcgttctactgcacttaagtcttaagacacctctaaggaggacgcatgaggaagcctgccttccctacacctttggcaagatgcactgagaattacacactggccttgactagagtgctgaaggtggtttctgggggacagaaacagcctcaggggcaaatattttaggggtacgaagcaaagcacttcaaacttgagtcagtggctacaggaagtggaggtgttggttgttttcccgctggatttcttcgtgtgtgtgtgtgtgtgtgtgtgtgttgggggggggcggggggggggttccttggtgttatcccgtgtggagtttctgctatacaccattaagaggtttcaagggtcatccctccacacacatttgaaatgaggctgaagcaagtacctctggtacttccttccaaagctcagccttggctctgcaatcctgtaatacagttccgtgtgttctggtgatcccccgcccccttcataaaattagtttcattgctccctcatagctgtgatttgctactgttaggaaccataatagaaacacctggtgcacagggtatctgatgtgaccccctccccaaaaggggtcacgcccacagattgagaaccgctgttccaaggccattagagaagaggtcctgatgttgagcggtggttttctggacactgcctgatgaacatgtgccttgctggataactgacataccccaatacaccatgttcctgcagattattggcctcctcggcgaaggataagcttgtaaaagaattaaactcaaatcacttccttttatttgtgcttttcatgattattctatgatacaaacttttttcctcttttttaaaaaaatttaattcattgagccttgagatgatgatgaggtggctgtctagttaaaaattggctctgaactaatttctgtactagtttcaagttgagagaatgaacagatgcaggaatttgaggagctaactttagttttgtttttttaatttttttttattttttaagttgtttttttttttttttagttcaaattaggaacaagcttgcttcacatgtcaatcccttctcctcccccaacccccacctgccccccaccccatccaccctccactccccaggcagggtagggctcctcgatggggctccccaaagtccaccacatcaaccttggctggtcctaggccctcccccatgtgtccaggcggagagtgcatcccttcacgtgggctgggctctcaaagtcccttcttacaccagggaaaaatactgatccactaccaggggccccctagagtgcagaggcctcctcgttgacatccatgttcaggggtctggatcagtcctgtgctggcctctcagacagcagtctggggtccatgtgctcccccttgttcaggccagctgtttctgtgggtttcacaagcctggtaccgacccctttgatcttcattcctccctctctgcaacaagttccagagttcagttcagtgtgtatctgtggatgtttgggtctcacactgtagcctcagactcatggcagtcctctacgtgagtgcttgcattataggtgtgttgccctcaggtctctggagagctaactttaacagcaggtttggaaaggtctggataggtttgggtgagtctgaattaggtgaattctgtgaacaagaagaagagggcctgtctgaggcgccaccctcgctggtactgtgacagaacctgcgtgtttgacttacaaggcagcagcaagggtttcctctgttcaatgctgctgcgttccagagccttcaagaattttatacaagctcacgcagggccgtcttccactgaaagggtggacacgttgttaattgcacactcttggggtgtgttccggctgaacttaagattgctggttttttgtggcttgctgagggcttagtcacccctctgtcttcatggggctctgactgagaaagaggcaacatcactcatactgcctcacacttatgacaggccttaaagctcacagagagattccacctagattatctttttgtctatctcagcacccctgtgaactaggtgggggggcattagtaacactcttgctaggcagtaaatttagaattggacaacatatctgaccagtccaaggatagtatatattttctaacatgctctaaagaagtcagtgagagaaaaccagtcacacctaagctccatcccaataacaacttttcacagaaggtgtttgacctatgttccgtcagtccagactgtcttgcagtcctaattctcatgcatatttactgacataaaatgagaagtcacccgttggaagagttccaaggagcagtctttatgctcctccagagcccccatgggaaactttaagtccacagtgagcttcctgagggtgggggctgagtcataacacccaaggcacaggcaggactcctggcgggattacaataagcaccgtctgatgtctggtatttcctcacccattcagccacatactcaggcctcaatgctgtctgtacagatgttgtcctagctatccaaagatgtcatttcaaaggagcagcattggggtattctaaaattcaccacaacatatatttctgtgtcaaaagaccccttcctgatgaactatgataggaatctgtagcaacagtgaggggccctactgcttctctttccacaagtgaatgagttgatgagaatggcccataggtcacagggctgtgttatgcatgaacatcaacttgtgtttttgctgcaccaaggcaatgtagtttcgttactggcctcatatttgtcaaaataatctacggcattagctcacagatgtcctttcatgcttgcttgtgaacaaacaactttagtatttatgcttcgaaaactttgtataactctctttgttattgctaatatgtaggaaataatttctgagccttgtaggataatgctgccaaggacagcatgtctcaacggcagcctttggtcttcacagacatgtgccaggtacttctgagtcacattgcagccgtgatggtcttcaagcctgggttaacattttgaaggtgccattttctgcctcatataaactattcactctcaggatagggttatatcttagtgataaatcttagtggatttatagcttagcgcttacttagcatgtgcaaggccgtgagttcaatcctcagcactgccaagcccaatgaacaaatgttgatctatagtagtattttaggaatttatttagttttgatttatttattttatttatttagtttttttgagacaatgttttaaaatcatttttatttagatgtatttgtgtgtgtgtgtgtgtatgtttgtgtatgtgtgtctgtgtgtgtctgtgtgtgtttgtgtgtgtgtgtgtatgtgtgcaggtgtgtgtgtgtgtgtgtatgtgtgtctgtgtgtgtgtgtgtgtgtgtgtgtgtatgtgcacatgtgcatgcagtacctgtgaaagccaaaagagggcatcggatcacttggaactggagttacaggtggttggttgtgagttgttcactgtgggtactggaaaccaaacttgggtcctctggaagagcaggaggtcttttaaccaccaacccatctcttcagcttcatattggtatttttaaagtttgaaattatggattgcttttctggttattaaagtggaacgattgggctggagagacggctcaggggttaagagcaccggctgttcttccagaggtcctgagttcaattcccagcaatcacatggtagctcacaaccatctgtgatgtgatctggtgccctcttctggcctgcagggatacatgcagaaagaacactgtattcataattaacaaataaaccttaaaataaaggaagtggggcaattgatagactttgtggtccaaacaagatgacttagtaggtaaagggctctctctgctgtatcatgacatgtgctttattcctggaactgacaaggtagaaggagagaaccaacttctacaagttattctctggcttccacagtgtccaaaccaaccaaccaaccaaccaaccaaccagtgaatagaatctatgtatataattataaggtcattatgtctcctgttttatttttaatttcttaaacatgctagtcatactccttgtcttagggttctgttgctatgaagagacaccatgaccgtggcaattcatataaaggaaagcttttggttggggctggcttatggctcagaggtttagttcattatccttatggtgggaagcaagatggcacacaggcagagagggagagaaagagagagagagagagagagagagagagagagagagagagagacagagagacagagacagagacagagacagacacagttagagagactctgggcctggcttgagcatttgaaaccctaaagcccaccctctgtgacactcttccttcaacaaggcccacaattcctaatctctgctaagtaaaaccactccctgatgaccaaacattcaaatacatgagcctgtggtagcattcttactcaaaccaccacagcccttgatcattttataccattagaacagttaagactgtggctgaatggatatttgactctactgaattttattttttttttgatatacacttaaagcgagactgtctctaaatagtagtagcatatttgttaaaacacagtaagtttttttttaaggatgttttgttttagtttatttatttatttatttatttatttatttatttatttatttatttatttatttatttgtgacagagtcttactacatagcccaggctgtcctggaactcactatgtaaaccaggctgaccttgaactctcagagatctgcctgcccgtgcctcccaagtgctgggattaaagaaggtgtgtgtcaccatgaccatcagaatttttttattgtatatgagcccttggcctttatgtatgtgtgtgcatgcctgttgcccaagaaggtcagaagagggtgttgggtccccagaatttgagccatccctggctgagttactctgccactgagccatctttccggcccctcgtttattgctctgtcatgtgtgttgtcagggtgtcagactctagagggagttggaccactggacatgtctgcattggggtgggcagcagagtccctggctgggatccggggccatgtaagtggaggcaggaggctgggcagcaggcagccatcgcttccttccctctgaccatggctggtgtgacagctgctattgagaattttatcactgaatcaggaggagcatccgggaccctcagcccttgggagttgacccgtgttttgtgttgagatcactcgagcacacgagcactcgagacctgctgagcccgctcttcccattaggaaggggtcactgctgagctcttccgttttggagacatcactaccatggttgcctatgattgtggtctccagcctacagatttaggtatttggaaatcaggaccacagttttggcttttgttttgtttgatttttttccccttcctattatactgtctctcagattttcaccatgttcaccccaggtatttggagcccaggggatccgaatggatggctgcaatggtcatgtggttatttcttgcatcaaatatactgaacatggacaagcaatacaggggcagatacagcatcttttttgtttgttttgttttgaggtggagtagtccaggctggccttgaactcaccatctatctgtctctgcctcctgagtgttgggactcatgacaattaaatacctcatcaagccaggcatggttgtaccaagctttcttttgggccacaaatcagctcccaaatcatgacatggggacttattcttagttatgaatgcttggccttatcttagatcttactttgatctgtttatctagggctttttttttttttacctttctttctttcttgctttctttctttctttcttggtttctttctttctttttttctttctgtggttctttctttcttttttttttttttggtctttcgagacagggtttctttgtggctttggcgcctgtcctggcactagctctggagaccaggctggcctcgaactcacagagatccacctgcctctgcctcctgagtgctgggattaaaggcatgcgccaccaacgcccctgtgtttctttctttcgctgcttcctgtgcctggcttctggtcccaggagtgtctctctctccctcattctatcttcctttccccttctcttttggtcttctcaagcctagatttcccctatttattctccctgcctgtcatccctgcctacctttctctgcctacctatttgctgttcagctccttattagaccaattaggaaccttaggcaggcacagtgaaacaactacacatcttttcaattaaacaaatgcaacataaataaaagtaacacatcttttttttttttttttttttttttttgagacagggtttctctgtgtagcttttggagcctgtcctggcactcgctctgtagaccaggctggcctcgaacttaccgagatctgcctgcctctgcctcctgagtgctgggattaaaggtgcttgccaccaacgcccagcttacatcattaaacaaacgcagcataaacaaatgtaacacaccttcacatagttacagtaatattctacagcataaacaaaagtaacacatctttaaatggttaaccattccacaacatgtggtggcttgtgcctgctgccctagtactgtcaagggaaagacaggaaggcccggaaatcaagaccatcttgtctacctagtaagatggaggtcagcctgggctacatgagaccccgtctcaaaaatccaaagccaactacaataagaattgccttctccagacacgtcattgacttcctcatgaattacactagctagaatgtttcacaaaacactaatgaagaagcatctgttttaatgaaacagtttaatgaacagtttaaaacagtttaatgaaactgttttaagtaggtatttgaaaaggatgttatagagtgcattaagactgtccccaaatactaaaagatattcatgtctcaaactaggcttacaaagggtgtctagaaagtacccagagccttagtcacactgctccgtttgtttctcagactgccttttcaaggtctgccccatgaatcgatactctgcccagaagcaatattggaaagccaagcaggcgaagcaaggaaaccacacagaggctgccctgctgaagaagcttcaggtaagtcgctgccctctttctccgaggctcgcccctgaggctggcccgagagcaacaataacaagcaggcaccgggccgctcgccttgctgatttcaccattgtgtagagatttcagttagagctcaggcagagtgcagaggtaagtagttttccgttgtagggcgtacctacttatttcctggcatgtgggcaacacatccccactgttattttttaaggtgtgccgggctaattctcaacttctcaccaaaccaaaaaggaattaaaaaaaccctgactgttaaatctaattatattttaccctttatagtactttttcccccctaacagtctatagagaaaaaataatatatatatatagtttgactgagtctgaatttgataatactaagttttgtatcatttaaatcctaggtactctcaggactgaaagctatattttgaggttttaatttacctgcttttctaacagtttcacatcatactgtagagaagtttctagttccacagaaccttctacttaactgaaatttgcagtatagaaacaaatggtccaagacaggtttggctgtattcagcatagattgtaaagttgctgccacacttggggtggggtggcttgggggagatctgggagcctagtgtaaatgtacccccaattacaaaaaacttccttgctggacatggtggtatgtgcattaaccccagcactatgcaggcagaggcaggcaggtctctgagcttgagtctagctgagcctacagagtaagttccgggacagccagggctacacagagaaaccgtctgaaatccagctctctaataacacagcctgtctgctttattcttgttactaagtctctgcttgctatgcttccacactgaatacttggtcgtcctcttgcagcatgctgctgagctggagcagaaacagaatgagtcggagaacaagaaactgttgggagaaatcgtgaaatacagcaacgttatacaagtaagtcttcattttgtcatcagagagggaagtcctttatgggtgagccgtcaaactacccacatgtcaagctgtatgaagcatttgtgataccgtgttcttctttggaggggatgatgattagtctgaggctttcagtgaacatgcatcatatcatgtatgtattgaatacatcttgtgccaggcccaatggcgctggcctgcaagtcccgaacataggcgatccgtgcaggcactcggaaaactgatctcttggtgggagcttaagttaccaaaggtaagactgtgcaggagggtttgtaaggcccagaagacatagtcctttaggtggatgggctgatgcttgatgatttcccggggtcaaggggaaagttttcgtattgtacatttatttaacaggcaatattgctttggcttccagtcctcattgtcagggtgcacattgacttatctcaactgcacccccccttcattcagatcttttaggcttcttttgtttgtttgtttgctagcaagtgccccaccttgtttcaaagaagaatgtgaggccttttccaagaaacacacagcacattggtagataaagcaccagttgccaagggaggcagctgggtggaagggaaaataatggtggctggacgaggtgaagtaaaaaatgaggcttgcttacaaagctcagtaaaacccagccaagacaccgctgtcactgtgaccccagcccaaggcactgctgtcactgtgaccccagcccaaggcattgctgtcactgtgaccccagcccaaggcattgctgtcactgtgaccccagcccaaggcactgctgtcactgtgaccccagcccaaggcactgctgtcactgtgaccccagcccaaggcattgctgtcactgtgaccccagcccaaggcattgctgtcactgtgaccccagcccaaagcattgctgtcactgtgaccccagcccaaagcattgctgtcactgtgaccccagcccaaagcattgctgtcactgtgaccccagcccaagacaccgctgtcactgtgaccccagcccaagacaccgctgtcactgtgaccccagcccaagacaccgctgtcactgtgaccccagcccaagacaccactgtcactgtgaccccagcccaaggcattgctgtcactgtgaccccagcccaaggcactgctgctgctgcttggccacaggagggaccctgctagagccccggtagtggaggtctgtagcatagagcccatctggggactggaagcacattcattcccagaagtgagatcaggaaaatgtttcccttgagtgctcataaagaagacactgtttaaaatggtaaacaccaccctgcacaggttccttacagtaatcaccacaatgaggcacttaacaaggccacattaaagaataatgtctcctggtgttctgtcatggacaaatggcagtgtgccagagggcagggcaaagctgttccccacaggacagggtggagggcgtgactttcggcttggtgggactgcacatcccctaagtagacttccagagatgatgtctcttcactgagctttggtgactcatttaagctccttgtcaagtacttcaagtacaatgcttgtcttacttaggggctgcgttctgtgctttgacatggatcctggaggtacatactaaggcttgagggtgtgtgtgtgcaggtatgcatgtgtgtgcatgtgtttatgtgtgtgtatgcctgggtatgtatgcatgtgtgcatgtatgcatatgtgtgcatgtgtgtgtatgcatgtgtgtgcatacatatgcatgtctgtgcatacgtgtgtgcatgtatgcatatgtatgcatgtgtgtgcatgtgtgtgcatgcatgcatgtgcatgtctgtgtgcatacatgtgtgtgcatgtgcatgtctgtgtgcatacgtgtgtgtgcatgcgtgtgtttgtgtgtgtgtgtgtgtgtgtgtgtgtgatgtgtgtgtgtgtgtgtgtgtgtgtgtgtgtgtaagcctgaagtcagcctcatctcaggtgttgttcttaggagctgccccatggtgtttttggagactaggtctctcacagcctggacttgtggatccagctaggcaggctgccagggagcccagggatacacttcccgagtgctggggttacaagtgtgtgcctcctcatcctgctttcggttttgattttttaacttgggggattgaacttgggccctcaggcttgtaaggcagcacttgaccagttgagctagttcccagacccatggtttttcatgccttcattagtacaataagaaccaagggtagggcctggagttttacaaaaagataattcttgttttttcaattaaaaaattgccattttactttgaaataacttctgcctcatcttatgggtactaaaatgtcccttctcttttggctgattttgaaactagatgggaagtttgcctttgtagttctacccaataaggttatattttgggaagactgtctatggtgtccatggggaagggagaggtgaggaccagtgtgcgttagtactgtcgatgggcagggtgcttagggtgtggcgtaggcctctgattttcttcagcagattctgcttgtgtggctgtaagagtattggaaatgggtgaggttcaggcaccctccggcttttttggaaagcctgattttagtctgctatttctcagtggatgaaggtgtcttcagtgtcccctggggtatcttccacacacagtcaccatcacccttgaagcagaacttggggtggagacgaggaggagacaggcaggcaggttggcaagttggaggttgctgagccttaaagtagctcccgtgtttagtttccagcatgagttgtggtgtgtggatttatgaatgcagctacctgaggagaccacagatacaggctctaacactcacctttcctctgcagctactgcatataaagagcaacaagtacctgactgtcaacaagaggttgcctgctctgctggagaagaatgccatgcgcgtgtccttggatgccgcagggaacgaagggtcctggttctacatccatcccttctggaagctgagaagcgagggtgataatgtatgtgtgggcaaaaccaagggagaagcaaacaacccacggtgtgctagagaactccgaaagtacagtcttcagccagttaactctaaactacttaagttagcatagggaatgatgggctgcattatggcggttttacatatatgtgtcattcattgcactttctaacacgtttggcgttagcattgttttactaggttaagtgcatttgtttacaatataggccacgctcagaaatcacaggacagttaatcaagttagcagagagccatggcaatgttctgttcagtatcttcacagacaacttcttacagtgttgtcacagtgtgcagggtttgagggacatctgcccactgtcaatgacaataaactggggtgtataaatggctgtgatgtcgccagagcttagatcagcggttctcaaccttcctaatgctgtgaccctttaataagttcctcatgttatggtgaccccaaccataaaatcattttcgttgttgctccataactgtaattttgctactgttatgaatcataatgcaaacacctgtgttttcctatgagatggtcttaggtgacctctgtgaaagggtcattcaagctccaaaggggttgtgagccacaggttgggaaccactggcttagatcttttctgctattttgtggaagagaaaaaaagtgagataattccataggaatcattgcctcatcttctctatttatggagatggctcatcttctctatttatggagatgcttctcactatattcttgcctgacttgtaatatagcataggctgacctcaaactggtattggtcctcctgcctcagcatcagcctactgactgctgggattctagttgtgcattgccacacctggttaacaatttgacatttttgtggtagtccttagctcctggaagatgctcagtaaagacaggtttataagtagaactccacacaaatgccaggtgatcaatacttgccgtgtggaaaagctcatatgaattctgactgaattgaaaatgtaattctcctgccatgtttcacaatcagtacttgggttgcatctttagggtgtttggaggtatttcttatgtgagaattgtcttctttttatagagaatctctttttttccctcagtgaattttaaagtacaaattcaattctacaggacacaagcgccatgatttaattgggttagtaatttttctggtgatgctttccttaggtaaggtctgtgctgcatggcatgcagggatggactggattcttgggaaactagttctcccttcccctgcttacttttgatatgaagtgatgtgtgctggcagcatggcgcgtccttacactggatttgtagttaattacactcaactctcaatcattcaagggctaaaatgtagtttgggaactatccacttctcttgtaatggtgtccccaacccccaactcctctataggtggttcatgaaaaccaaacgtcaaatcaaacaaatcctaactacgctcaaactaaaagagtgtgatgacatggtgaaatgagcctctctctgcctttgggttgctgtgaatttcatggttccctctgctgattcctcctttgactttctctccttgcttgcaagccacttgatagtatcaggagagagttgaatgtaacaactactttagacaattagtttcagcagaaacaaaccttgtctttgtggccgccccacagtgcgttaagttgttcttttctggatgcactccacaaagtcccgctgccacagtcttccaccttcttgctgaaaccgtcactgtgttcgttcacctctatatggctttgtgtgtgatgaacgttgccgaggaaggctggcatgcccacagccttgtgtcagcctcgcacggacctgtatgcaactcttgttttcttggctaggaacaggcagtgttttaaaacatcagactgtagtttattgaaggcagttttgccaatgctgtctctttgagtggtttaattatgactgagtttctgcgtaagtatcttaaatggagaggaaattgcaatgttcagaggaattttaaaattgcagtttggtatttagcaatgagcgaaggagagacttgggttgtgtgtaaccaacaagaagtcctcggggctcaagtggagaatgatgcagatggcagcctggagtgcacgctgttccttgagctaagtgcatgaaggtgcactaggtaggatgcatggtttgggggaaacgggtttacaggtcccttcactgtcagctgtatagaaagtccttcactgctgctaagttactagaaaaaccaccgaggtcactggtgagccgaaaacatgggtatttcatttccacgtgtcctcttcatgtttgagcatttaactcttttcctttttagtcttgacctgagaagacaagggtcctttgccctgatgtagatttagaagcataaagaggtagaattcttgaagtcagtagaaaattctaactcacggtgaggaactctggcaggcagattttgtgatttcacagaatgacaagcctggcatttgtagcagaggcagagatagggcattggtgttttctgattcccactgtgaggttcctcttactgtcccaaatgacactcagagcagggacagccagctgcaggtggcatcgttatcagtgaaatcccatctgcagcgtgacatggtcactgcatagacccaacagaagtctttgggattataagatgtaaaagcaaagggcctcgccctctggttatgcatcaaatagagtttcttagggtccgtcaggcctgaagcctcactcttctgagaataattccaacacatctagtaatgcgaattccccgagattatggactgtttcttatacacacgttttccctagtccctcttcagtgctatctaaaaaatgatatactttattttctgtaaatgagtgtttgctggcatctgtgtttggaaggtgggatgaggtctacaggcctgtcctacaaacagcaggcactcatcccacaaagccaagggcaccttcctgcgctgggttactgaacttgaggcttcttggacacagataggtctctagatgcagcgtgcggcaacacagctcctcaatagtacacatttagggtcatgggaccctgaaaatgtgagcgtgtgttttggttaaggtacatggagatgtcccaagtcccaattgttttctcatttatgtaacaaagcaatctttaattgttctaacatgtaattggtatgaaacatgcaaagggaaggtttttgattttgcttcagagtgggaaagccccacagctgggaaagtagatgccacaaaaccgtcttctaaagaaattaagggtggctggagagacggctcaatggttaagagcactggctgctcttccagaggtcctgagttcaattctcagcaaccacatggtggctcacaaccatctatagtgtgatctgatgacctcttttggcataaaggtgaatatacagatagaaaacacaagcacacacacacacacacacacacacacacacacacacacacacacacgtatataaaataaatcttaaaaagaaaagcaaaaacgaaaaagaactagcacaagtctctccagttactaaaatcacactgttattgccattaagaaaaggtaaattcaattccctcaagtctaattagatataaagatatttgcatgtaaaatagacattgctcttatcacacagatgactataaatacagacttaaatttttttagtactttcccctggaaccctgataattcttattttaaaagaaacacaggctcctacagttttggttttagacatttcaagtaaaagggaaccgaaagctccaggcctgacaaagcatagatttttccaaggttgtgccctgctttgtatttcctgaacccagaggtcagatgcttcataattctgagattcgggatgattagttaagcagacccacagcctttcggtggagggggagcatcgcctttcagtggggagggagcatggagggatgtgttctctgctaccctggtgagattctgaagcttggctagaaggaacatcgtggtagctgccttcactgtgtcagccgcaaggacttttgggaagaaaatcgcctgattctgacctctgagaagccccaggtgacatggagactaacggggactagggtttggcaggcatggaacactgaacacgcttctcagggagaagagtcaagtcacaatctgtagaatgacaggaccgggaggcaggctgctggtgaggactgctggggtgtttccagcctcagagcatcagggtgtgtttctgattcccagatcgtcgtaggagataaagttgttctgatgccggtgaacgctgggcagcccctgcatgccagcaatgtggaactcctggacaacccaggctgcaaagaggtgagtccaggcgggagaggaaggggtgctgattttctctagggggagggaggaagagagtaggacagaggaaggaagacagaaaggagaggagggagagaaggaagagcagagagggggagggagggagggacctgttttttcctttggtgggtcggtgcttgcatatgtggtgagagagtgagcacctgtatggggtgggggcaggaggcatccagacgctgtgtgcctgtggttcctgcaatggtagctctattcaggacccttttgttttttttaaaaaaaaaaaaaggaaaggggagagagagagagagagagagagagggagagagagggagagagagaggggggagggagggagaggggagggagggagggagggaaaggggagggagggagggagagcgtgttgtttcttgattctcttgagcaccatgcaggcagtgttagcacccttgggcatctgtaggtactgcctgtcttgaatggttctttgaagatgttttttattgaggcctacactttgttgtccatagttgtcttttttcttctcctgtttggaatggtgatttttggtacagaacacagagtctactgtcttatgtctttaacatttgtctccaccaataggtgaatgctgtcaattgcaacactagctggaaaatcactttattcatgaaattcagctcctatcgtgaggatgtgttgaaaggggtgagtaagccctccatacaaacctttattctcaagcgccagtaatctgacatgtgctcagagccttcaaggataggcgaaggccctgcagcccagagtgcccaggtcagaaaggaactgcaggacccccagtttcctggtggtggccgctggatggttaccatttcctcacctgtttctccagggtgatgtcgtgagactgtttcatgccgaacaagagaagtttctgacctgtgatgactacgagaaaaaacagcacattttccttcggacgaccttgcgtcagtcagcaacgtcagctactagttctaaagcactctgggaaatagaggtatgtacttttgggggggaggaggtttgctaaatatttatataaaaagataaagatcatcaggctgttggctttgctgttacgggtaacattggtggcatgtctataacatggaataatttttgtgaattaacacataatctctttgtggctgtgaccaatttgaaaggaacatgtcacccattataaagcagaacaaattaatcaaggggttgaaaagagaaaacatttccattgtgaattcatcagtgctgatcagactggaagccatgtgcctctgtggcactgcgtcatgactggcagaggcagagacagatctgtagtgagagctaccagatgcacctgtggcactgaccacacccatttgggcgtgatcacaggtgcgtatgtgagcgtgagcatgtgggatttggcctgggctccaagacaggctgtgctctctcttggttctggtcgggtcacagagagcggcaggacattgatcctcggagctaacttgtgggttatcgggttctcatgtaagtgacttctccctgaataaaattaaatattatcctagtctcatgtatcttaatctgtacatccacacagaacctatagccacggaaaatagcgggtatttttttctttgaatgcatcaaaatcgagatacgcatagctaagcatgctattcaccaggctgaggcaggacagtcacaagtttgagatcagccaggtctcctaagcaagctggaagaatggttgttaagcagctcctggcaagggcttcatgcagtccgtggtgcctggtgtggtgcgggtgttctgccaagaccttcccagttctgcagcctaatgatggtacatattagacagggtctactttatagtccaggctggcccggaactcactgtgcagcacaaagggatcctgaaccttttgtaatccttgtgcctcatcacaccaagtcctgggattttatgtgtgagcctctgtcccctgaccggaaacattgccttttgcagtaagacagtgtttacaggtgtgaggcacgggctctctcaagtgaggtgtgacgtgtcttatgctcactgatgggaagttgtgtttttctcccacattgtgctctcgggggtacatgttagatgggttggcatacacaacaggttactctggctgatgacacctgctggctgccatgtggataccattttgtcactgaaactctccctctctgtaggtggttcaccacgatccgtgccggggcggtgcaggacagtggaacagcctgttcagatttaaacatcttgccactgggaactacttagctgccgaggtgagactgttggttacagtgttgttaggtctctgcctgaaacaacgaaccaggcaacccctttctgtgaaagtcattgcattgtcagggaccattcctgtgatttgaatattgcctgtcatgtctggcttggtgtttttctgtccctccctggccccgctgttatgataaaataccctgacaaaaacctcaggtgagaaaggagttattttggctcatggctaataagatacagaccaccatgtggaagtcagggcagcagaacatgaaccagtcatcgagagctgatgagggcttccgctcagctggttctctcctgttcatacagctcagggaatggtgccgcccacagtggtcaagtctttctacctcagccttctcaggattaaccccccttggccacccacagacccttctctcagctgattatagagctcatcaagttggtcactacgattaatccttacagttagactatgagtcactattgtgtgtttgtatgtgtaatgcatgtatgtttcctgcgtgtgtgtgtgtgtgtgtgtgtgtgtgtgtgtaggatgaatgtgcatttgagggcttgtgtgtggagaccattggtgagcctcatgtctttttgctcaggattccatcccctatgggtttggaggatcttggggttgaagactagatcaagagttaggctcctcaggatagggcggctactggagtaatctctgttattcgccaactacctatagcctgcacgtttagtatgtgtttgtatttcttgcttggcattgttcttgctggttgcagttctagttttctgtgcgttcaagcctgaatgctatgtcattgggcaccgtggtctgcatgggagacagaaccaggaagctttcctcagctctgtatatacatcacagatcccactttttgttttaagctttgtttttaggttgtatgtggaaacttgagaggcccacattgggtgtcagatattgctggagactttgccttgtctgggtcccatttgactggtttctctccacctaccaggtcctcacaactgcttataagataacggctcactgtttgtccaatggcttaggattattactggctagctctctctcttataaaattaaaccatatctactaatctgtgtgtggctgtggcttactccggagatgctctggcatgttacctcctggtggctacatggaatctccttgactccatcttctttctctatctctgtttggatttcctgtctggctgtattctgcctgtctattagccccaacagctttattaatcaaccaataaaagcaacacatatttgtagtatacagaaggacatcccatgtcatcagggtctctcacttttactggagctatctgattaggccaggcaggttggccagagtgtagcatgataaataaaagacccagaaacagatattggggttcaagcttcaagctgaagatcagaaaagcaaagcagccagccactaactcttactctacctcagactgaaaggtgatcctggctccaccaaacctcagactgcaatcccagacggctaggctctcctcagcatggctggaaaatcctaagactgactactgaagacctgctcctatcttttatatctccttagtgctagaattaaaggcatgagctttgttattctttcagactgattcaatctcctgtagccctgggtggccttgaactcagagagattcatccacctttgtctctcgagtcctgggattaaagatgtgtgccaccactgcctgatctctatagcttgaggctgactttgctttctgaatcctcaggtggtaagctttaataaatcataaataacatatcaccacccagagaaactgacagaggtaccacattgatgaagaaagtcattcagctcattaattagttagcttaggtgttctgcaaaagcagttgcatgctcttagagccatctctctgccccccacccctagtttattatggttaatctgaggtgctcataacagtttctctgcatttggaaatttggggattgagatggggctgacagtagatttttatctcatcagtcccaggaattggagaggatgatgtgtttagactggaacctccaagaagcctgggagcctgagaagctggggacaactagaaaacccagtgggttgaatcataagtgccaggaagtcagggcagtgtttcaccggggttggggtgaggtgtgcgtgcgtgcgtgcatatcgtgcatgtgtgtatgtgtgtgtgtgtgtgttgcacaggccagggtgtggccatgagtggcttcatgcagagttcttcaggggagcccagctgaagggagggtgggccgagttctcgaatgcccttcaccgggagaagcagcagtgatgaggggaagccctaagtccagtctatgctctgtataaaatggatttaaaaatcagacaggggattgtcctccttttgcatagaagggaagtgcccagcaggggacctggacggccagggttgtgctctctttcccaccctggggaggaatatttatagattaaaacatggatgtgttttagacaatcctggtcaaaagagattacataatcctggagctgcttttgggtttacagtgctaattaggcaaagagagcctataatggtacaaaggattgtcatacctacggccccctgtgtgtcaggctttaagcagacatttagcctctgtctggacccaagttctcttgtgtgagacccaggcggtcatctgtgttctgaggggttgtgctggaataaagaagacaggaatgtacagcaccatgttcacaaaaagtctgggagatttgaagtgcctctcctctgtggagagtcaggagagaaggcggagagcagcatcctgtccccatgagcatcaatgtccttgcaaccagctagtgtgtagttgtttatgtgtttgttcatccatctgtgcattgtgtatgtgcattgtgtatatgcctgtcagtgtggatggtgtctctacagtgtggacagtgtctctgcagtgtggacagtgtgtctctgcagtgtggtcagtgtgtctctacaatatggacagtgtgtctctacagtgtgaacagtgtgtctctacagtgtggacagtgtctctacagtgtagatggtgtctctacagtgtggactgtctctcacactacccagctctccactgtgaacagtgtattacactacttggctctgtacagtgtggacggtgtctctacagcatggacagtgactctacagtgtggacagtgtgtctctacagtgtggacagtgtgtctctacagtgtggacggtgtctctgcagtgtggacagtgtgtctctacagcgtggacagtgactcacactgaatttgcactcaccagagactaggttgctgactggataggaactatggctgctgcaaatacagtggtttcctttcatagagaaggttatatagaacctttctctgagaggttatataaacaagaaaccttaaacagataaaaaaataatgtaacaactgtgttcaggctggatgctgcttttggactactgcactgtgtaatttgtcagtggtttggacaatatctggagatggttggctgacatacttgggaagggggctgggatctgccgctagacctcatggatggctaaggcagagggccattttctcctctgctgacagaattatctggtcccaaacacaaagcatccagaggccaagaaaccttgctctacctcagtctgacatgaaacagtcacttactgaatgcctccatgtggaagagctctagagaggcacagatgttaactgtggttgctgtctgctaagtgcctgccgtctgtgggggactgtacagcgcaccaccgagccatatatcggctcttactgtgttgattgctcccatcagatacatctgagacctctggctttagtaaatgtttaaattaccaacatctaggtgtgcacactaaaatcagcaagtttaaagatggcaactttaagagcagaaaagagaaagaaactctgcagcattatttgtgaacatagtgctcagtgcaactcttttaaccagcatttcacaaggaaatgaagttatccagataatcgtggtgagcataagattcgtgcggaacagcagaggccacaagtcaagggaagccgggtgttccgtaggctgagactctatagtgaattatgcagccagcatgcacagttgtaaaccgctgacgaataggatctctgtaaaagattggctgaatgtagaaaacataacgacttagggcagcactgaaggatgtaattgggttttactctgcaagaccacagagtaagccaaggtttagaagaccccccactcacccaccaccccacccccggccatgcagttttacatagtgtggattaattttcaggaaatacgcagggccataaaactgtggttgaaatctatatctatgtatttaattacagatcagataataaagacacgtggacttcatgtggttacacaggcatgtcactgggctctcagtaagtcccttccacggggcatacatgagttaggtggccagtgtggggatagatttcgggcagcacagctgtgggctcactgatgttgtgacttagatcttttatgcccttgtgacaggggtcatcttagaaacaggctagcatgggccttagaatcatctcccatcatgtgggaagggccactccatcacagcttccagcctgctgcttcctacattttctcaccgtggagattaaccactaaagcaaatgacgtgataattctttcccaaacaagacaaatcagagaatgtaagataattttatttgttaaagattccatattaccaagccaggcggtgatggcgcacacctttaatcccagcactcggaaggcagaggcaggcagatctctgtgagttcgagaccagcctggtctacaagagctagttccaggacagcctccaaagccatagagaaaccctgtctcgaaaaacaaaacaaaacaaaacaaaacaaaattccataatacctttggttttgcaagacagggtctcattctgtctgggctggaactcactgtgtttcagaggctggcttcgagttcctcatatcctgtctccccctcccaagtgcactctgccatgcctggctttggtagcatctttagagagtggctcacccagggcttggcggtgtgggtggggggggggggggttccctgggtaagctgcttgtcgggaaagcaagaggccctgagtttgtcctcgggtacatgcctaaaaagagccaggcatggtggcttgtgcttgtaatcccagcagacaactaggagggttctaagccagtgacactgtgtcaacaacaacaaaaggtgactggtgcctgaaaaaccgtgcatgtgcgcacacacacacacacacacacacacacacacacacacacacacacacacacacacacacacgctgaagaaaatgaactagcatatttgtttgtagataggacaagcttccaccagatggcactaagcacttcctaacttcgcagttaggtgcagttaattaaaaacttaatactagcaaagaggtcaggcttggcatctcacagttgtgtcccagcactcccagagggggacgcaggaggttcagaagctcaccccgccccccagcgactgtatagtgagtctgaggccagcctaaacttcaggagacattttctcaaacaaagaaacaccaaccaaaacaaacaaacaaacaaacaaacaaacaactcaaaccaaaacaaccagggaaatttgggggggggggatggttcagcccattaaggtgcttgcttccaaactgtggacctattgctctgcagttctgttgggtctcagcgcccatgtctccagaggatctggtgccctcttctggtctcaatgagaattgcacttatgtgcacaaactcatgagtgtgttccccactgcgcccccaaccaaaaaaaaaaaaaaaaaaaaagcaagaatatgagcacgtgttctgggcttctgtgatttcagtctgtttcttactgttgtgtggatgaaacactgagggcattttgcagctggcattgggactgttgactctttgcaatgatctgactcctctcctccacgttgcggtcgtgtttaactgtcttcaacagttgacgaagacgggtgttttttgatattgccagtaatctatgttcttctccttttgaggttcccatggctctgtggaccatgggtgtgatcttgcccatctcactgccttaaaagtgtagcaaatattattaaagcttgggttattttgccataacgcagtgatttctctcctagttcagggttagcatttgagaatcaagcatatctttctgtcgcagtttctatacttagatgctgctgaatgcaagcctataagattgactttatagcattcatttaaaagccttgtttgtcttgagtgatcttccttttagcttaaaatcctcgtggtctaggccctagacctagggtgatcttccttccaacataagggcctatccagtgtggaacccttctgttttgtttcacacactctgcttcctggaggcaggagagccagatgcagcagttactcagggtgtggattccatccctcagacatgtgccctcaccctgacacggcgtgggtgtgaccgcgtgaagtccctcatgcagtgcgcccagtgaagtagaatcgagagtattcctgagaagcagaattgtgaggctaagtggataaactctccaaacatatcttaaaagtatcacagagagactctgcaaataagtcccgagggtgcgggtgttccttctcctttacctgccacttaaaattcagtcccgagttcaaggattgctcagacccttgaacaattcttgaataagctagcgcatcacagactcctccctccctctctcctctgacccgtgttatttacaagtcattcatttctgcctcctagctcccatcacatctgcatcatggtatagctgaccacatttatgtcttattttccttcctaggccacagggtcagtggccagggacgggactcttggctaaaataccactcgacacaagtttgccccttagagatgctctatcaattacaagagttctctctctcccttgtgccagatttataattcagtttttaacataatgctgtattttccttcaaagtattaaaatatccagggacttccctagccatcattttcttccttctttagcaatatctttttctgtaatcctttgccgataactttgataaatacggctgttgctctatttggagaagggacaaagcggtagaatttgaggctgtgagtttatttgggtgttttcccttctctgtagtgacaaaacaactcgagagagggaatatatatatatatatatatatatatatatatatatatatataaacacagataatcataaagggttaatgacatttcagtgaaaatcaaacacaagtacaaaaccaacatccatgtcagcgtccactaaagcacagcagatgaaaacgcctccctcgcctggtacttaagcattttcacctgtgtgtgggcatgtgtgtgtgtgtatgtgcacacatatgtgtgtgggcatgtgtgtgtgtgtatgggcatgcatgtgtatatatgcgtgtaaatgtgtgtgtgtatgggcatgtatgtgtgggggcatgtgtgtgtgtgggcgtgtgtgtgtgtgtgtgtgtgtttacattcgtgtatatgtgtgtgtgagcatgtgtgtatgcgcatgtgtgtgtgggcgtatgtgggggcatgtgtgtgtatacatgtgtgtttatgtgtgtgtgtgggcatgtgtatgtatacatgtgtgtatgtgtgtgtgtgggcatgcgtgtgtacacatgtgtgtatatgtgggggggcatgtgtgtgtacacatgcgtgtatatgtgtgtgtggggggcatgtgtgtgtgggcatgtgtgtatgtgtgtgtgcgtacatgtgtgtgcatgagcatgcaggtgaatgcagggattgaactcaagccatcgtcactgtaactttttacttaacactagttttgctttgtctttcagcttaaccctgactatcgagatgctcaaaacgagggaaagactgtggtgagtagaagtccccgcagactgtcccaagcgtttcacaccctggtttacataaataagtcagagccttagtaaccagcttgagtgctgtggcccccaggacagagcctctcaactgaagggatggtgtgagaaagaggggcgcccaggggatctctgtccagcagggggcgctaagggacctcttgaagactggttattgaaaggcattgaggcttctgtagtaggtctaggtccagtttccagaagtacataagatgttaagataggacaggaagactctccttcttggatttaagatgatttgggatctgcttgaggggagaaattaaaactgcaatccatgtgtcatgggtggtgtcttgatatttttaagtgtccttcaggaatgactgtctctctgtctctccgtctctcccgcctccaatctgagattaaaggtgtgctccaccactgcctggcgagtgccacactcttaacaccagttttcacaagcgtttttcatgttacacactctgctcatcccctctctgtagcaggggtgtgggggacagtagggttagctttatttaaccaaagttcggaaactcgggggaagtagatgtagacaaacctctgggttagacacactttgagtgtgtgtacaaggtggcagatgttacttcatcatttaaaactctgtccttaggtgggcagtggtggcacacgcctttattcccgtcacttgggatgcagaggcagatggtctacaagagctagttcccggataggcgccaaagccacagggaagccctgtctcaagaaaacaaaaaacaaaaaacaaaaaacaaaacaaaacaaaaaaccccctctgtccttgtgttacacagtgttggtcaggcaggaggaggacatgttgacactgtcaccagggatctgttaataggtctgatttggttgtcagtgaagaccactttgcacctgccattatgtacagtcataactgtaattagtcaaataaacaaaaacagacccaaaagcaaaagttaaaataacaaacaagtcagtatcacccccctcccacggccagccgtctgccggtctgtccatctatctgtcttcttggagaagtgtctctttagaatgttttttgggttgtttattcttttgctgttgctttgagctaaaaagagtcacttctgggcgttcactcctcgtgaggtgtacacattcctccccttttccgaggcgtctctgcctctgtccctcatccctctgttttatggcttggtgtaatcccatgcatctgtgctttttgtcccctgcactgtctaaaacatcctcacacagacagtatcatgttgcgtttctttctttcttcttctttttttttttcttgtcaggaaaatgaaaatcaaaaccacattgtaacatcttctcaccccagctagaatgaccattgtcaaaaagacaacacaacagattctggcaaggccatggagaaagaggcctcctacaaagctggtggggtggatagtcggtgtgaatacagtgtggtaattcctcagaacttaagtgcggaattgcagtccaacccagcagacccactattgagtaacaaccctccgcagataaaagctagtatcgaccctcagctttcatgcctgattccctaaagcatttttcacaccagctgagacgtggaactagcctgtgtccacccacagctaagtgggttacaagtgtgcaccagtgcatctgttttatgtggcatggggcatggaacccagggccttgtacatgataggcaagtgtcctaccgtcccagcctcagccccagccccaagtgcctgatttaaatggtggcagtgtttgcctgactccccaggttcgtagtctatttttgtatggcttagtaggtccagcaagaacttctggacttggggggctggagaggtggcaatgctcttccaaaggtcctgagttcaattcccagcaagaacactgtatatatacataatcaataaataaatcttaaaaaaaaagagcttctgggcttgactcaatcccgttggacccctctttctattttattgtcagggtttaagtaggagtggagccggggggggggggcgggtcaggctgctggcccagtggaagttcactctgtgttcaaacatctctagatacaggtgggcttacttgattggttaggcctgtttatatttatacttgttttgagtgaggctgaagttttggttctggccagaggaggagttcacatgctactttttgtgtctagagtgtattactatcatgtctgggccgcttcttcagcaggcccacttgtggacattctggagagacctgctttccttgctgtctagtgggctggtgtctgcctgcccacctcaccttgtactccaagaaccaagacaggtcaaaaaaggtgttagtaggtttaaaaaaaaatacaagtagctggacctgtggtgcagacctgtcttccaagttactcagtggctgaggcaggaggaagggagaggggctgagagagccgatctgcgaccatgctgattattttccttaattttccctgtgtgttggcgacttaatgacctgctaatttttttccctgtaattcagaaatctttatcaaacaccgccttctatatttgaactttcagaggttaatgcatggtgtcgctgagatgagatggtgtgtgtgtcagggctcccattaagaccaaattgccgtgttcattttgcaaaggggcctgttatttccagtcttacaaatgcacagcttctctgggtacccggcaaacattggtaccttgtcaagcccagccgggtacctcacggtcattatttcttcttgaaagcccacatcttttcagacagctctgcagaggggattttttttttttctgcaatgtcattcatgttagggggacattgccgtgtatatgtggcatgggacctgatccttttgaaggagcgtctgtcatggaggcttgagggggacgtttcatggtgtctgcaatgctgacacacagcactagataattcttggtggtggtagtgggggatcttcggtgtgagtggtgggctgtcacctgcatgggttgtagtgggtgctccctgcatggtagtggggtaccctctggatggtagggtgatgggcagcatcattgatctcatcttattggggtgctagcagcaaccacacccctgccccagctctcagttgtgacaaccaaaaaaaaaaaaaatgtgttcagaaattgctagatgtcctctgattgtcaaaaccctcctgtgtggcaaaccacagacccgagtgcatttatatccttggggatgttctagagctggagtctgttgacacagtactttcaaattctgttctgtagagtttggagatggggagtcaggtgccagcagacctccacactgctttgggttttattccaggctcactggcagtaaggggtgcaggctgggcaagcagaaggggtcccgctctggggaggaggcttacagagatagcgtgcttgccacttccctaggcagcctggagtgtgtggcttccccaaggcagaactgggagggtggggatggggtgggtgggcagggatgccagtgacaggcgacacagcaacctcctgcagcctgaacctcagctcctcccagcatgtctcaggctccaacagtaccggcaatgtgaagtttgacctaaaatttggtgactcactatgagtcaccacaaaggtattctggggtgtcccgaagtgcacctcccgggaggtgccattagcttctttgtagctttgcataagggcaggtttctccctgtgtagccctggaaatctgtgccatctggggccgagaagacagctcagtcggttgagtgcttgctttgtaagcatgaagtcctaagttcaaccccagcacccacttacagtagctgccagtggcggtgccgtcctgtaaccccagcactggggaggcagaggctcaggcaggctcctggtggttgctgggcagtctgcctccaagtcccggtgagaccttgtctcaaaaactgaggtccaagattgatctctgatacacacacacacacacacacacacacacacacacacacacacacacagacacccctctgcacccagacatgaggacatgcacagccactcccatgtgtacgcgcatgcccacacatgtacaaacttatctgaagcgtacctgtctgacaagtacccaggggacaggaggcctgggacctgagctcctaagctgggcattcgtcagagagagcttgctggtgttccattagacacctgtttaagctccatgacgaaaggcaaactattgtgcttctgaaatcccctgcagggagctacagttgctgtctttctcttcccttagaaataagtgtgggtttataaacagaatccacaaagtccgtgagtttgaacagagttgtcatcattttgttaagatacagggtttcctttcttgtctattgaagctacgtccactattatatatgtaactagaatttttgggtggctctggcagtcctgacggccaggcttgacgtcctgatgtaccagttagagagagaattgattgtgaggagcagagaggggaaacggttttagggtggccacagaggaagaggagcagatgaggggccagtgagctcgtctgtcttcagggtcctggctcgagctctcggtttaaccagagtaagcctgggccccgactatgagccctggtcaaggctccatctggttacagctctctcacaccaggctgcacaggccgtgtgaagttaccgctgccaccttcacttgactggatcaatgggttcccccagagtgatcacttctgctcagggtacagcctctacccattgaggatttctcttcttggattcaaggtgactgcaggctgaggacaatgacttctccaagggcattgagatgggggaggaagacagacacttgtcagatccccttcctacactcagggtcagtctggcttctgagacaaagtgaaggagggcagagaagccaggcttccaccctgcctctcgccagcctgtgtggcgtctgcatagaagaacgttttccaggtgtcttgtatgttcataactcattattcatatttaattacttaaaaatgccaaggggcaggcttaatgtttacttccaaactgtttatgaagcagagtctgttaaataaattagagtgtgggaagccaaagcaggaagcttcagacagcagggccctcgtaaaagatatgtaggcacatcggaagtcttccacacacagttgtgaaatgatttatgtgcaggaattttcttcatattaaaactattttccaaagaccagtgggaaggatggggaaatacaatagcacattccatgtgttctgtctgtgtagttacaaatcttgaattctgtggataattagcagtggcttgttttaattaagcctaatcagtgagtttttaaaaataggtgtgttggaaagagtcattgcagtgcaatcgtcacagtgcagggagacccctgaccactctgattgggccccttaggcagacattaccaaggagaaccatataggaggccatctctaggaatctagatctgaaatcttcttgtaaatttaccaaagtcatctcaaagttggggtgaacagagggctgaatcccactaaatgtacagaccacacaaatgctgtcaactttcagatcctaaatagatctaaatagctgtatcagttagcacattttccccctggagtggtgtgtatcaaaagataaattataaggtaaggggcaggaaggctgagctaggaaatcagatggcatacttcttttagggagacagtatttttccaagaatgctggcaacttctttggtcttctaccagacactgttggaaccctgaacactggccctccaattgttgaggttgtgaaaccctcttctgccaataaagcttgtcttcaaaacatggttcactgcaaccaataggaacttacttccctgagctcagttgtgtttcaattataaccttccctatctgcccaaaccacttaagccctgcggtagtgcgagctgcccatgttccatgtgttggaaacttgatcctcagtgttgcagtggggttgggttccctcggaggaagtgggcatgagagacctcgctcatggattcctgggctggtctagggttggtgtggcttgtggcagaaccaagcctgctgggactcagttgctctggctcatagtgtggtattctccatgtcatgacgcagcaccagggccttcaacagctgtctgtctgtctgtctttggctgtttacaaggatagctttttggtttgttctgcagccagcctggggcacgggtctctgtgaggtagggactgactgtggtttttgctcaggcctctctgtgaggtagggactgtggttttttgctcaggcctctctgtgaggtagggattgtgatttttgtatttgaatgtgatcctgcatggttctcacatcctcatgcccacagggagagtccctgggtcacatgttttcataatggcataccatccacagggtgggtacaagggttccctttctctgcacctttggccgtttatcactggaccttggtcatgctgtccttagaagtgtgctgcctgcagcagttttgatttacattccccctgtaactagtgggacctatatgcatcggtcatttgtgtgtcttcttgagtccatggaatttagaggatttgggacgctgcttcttctctatgtttgatataaatgcagagggtacgaaaccactagagaaggggccataacgattgtgatttaaggacatgctcagattagaagacccctctggggagcatggaccgtatgactgcccataatcgttacaaaggctatgtgcctgatcttctgggggattcagagtagacactcctataacccaatggaagaacgcaaactcacaccttatctccggattgactggagcagctaacactaaatctgaagacaccgaataaccttgagcctcttcaacagagagatggagagcttccaacctcaaagaagaaacgccagactggggagaagattatgtacacgctagtctcagtaccacacggaaatgacatcgcatcccttttcgaacttgatgccacaactcttcagagagctgactgcctggttccaaggtaaaaagaaatagaaaataaaaggaaataagtaagtaaaaggaattggggtgaacagatgcttctttgaatagtcctcccaacaggaagaaataaaaaagtataattacaattttacaacagaagggagcatgagtggagaaaatgcatgcaaagctctgtgcctctgtcaggtgagctcatcaacacaacttattttatttgtatagataactaaaatgtgcagtaccaaagacatcctgaaaaaagtattagagtcatttattcttattaattgtgtggcctttggtcacgacaacgaaaaaaaataatctaatagcatttttagtctaaattttatcatttacctgtcagatttcctgcctagctcatttatatgctcattcttttagtggttcagctaagaagtatttgttgattgtcaattaccaggcagaccacgcccctggcatcaaaatgagacatgggtcatcaatcagagcaataaacacattagctcaggtgactcttgaacttgtggttcacagccagtgccccaagttgggtccagccacctgtgctcattaagccaattaaaagacccaaattaaaaacagaaagctgaaaaaggagatttatttggtgtagccataccagaaagggatatgaagagacctgaaaaccccctgttgcgtgtctgtctctccctcctccttgctcgataatgtagcccctgaagacatacattctgctgctttggcctgagccaagtgtctgtccttttgtatggtgtcttagttggggtttctatcactgtgaagagacaccatgaccacagcaactcttataaaggaaagcaactcattgggcctggcttacaatttcagaggtttagcctgttatcatcatgacaggtggcttgtaggcaggcatgttgctgaagaaggagctgagaggtctacatcttgatctataggcaacaggaagtgaaccgagtaccacactgggcacagcttgagcatataagacatcaaagcccgcctccacattgacacacttcctccaacaaggccacacccactccaaaaaggccacacctactccaataagccacacctcctaatagtgccactctgtgtgggggccattttctttctaaccacaacctatgggaccctgattattactctgacttaactcattttaggtctaagcaaaaatgggtatctttcttgaactcagtgtaggagaatttgcctgaggaagtagtgagaagaactcaccgtcaggtgcatgcacccaccacaaggttgctatgtctcacattgcacaggggtgttagctgctgctgttcagaagggctgaggttctttgccccgttgtgaagggttttgtgttgaagcattcagctgctgttcacggtttatagctaacaataaacctttaacgctagccacttttacatcctcatataaaatcctccagtgctttctatgtgccaagccccatgagttcttcaaggccattatctgggttcaccctgggtaactctcatgggtcagaggtcagaggtcagaggctgagttagagcaagtcttctcagactggctgagaaagatctgagcaatgggtcctggcccttctgagagtgaagaagtcagtctttcagtgagatatggacaccccatcttttaaaagcattatccagggggctccaatatgaaatgcagcatttccccaaactttaaattcttaccgtgtgatcttttcctggagggatgtgtacaaatgtttccaaacacagggcaccacaatagatcaaaggaaagattccattcaagtccagtgagtgaaccagtgagtctgttgggtttacttactggagcttagtgaggggttcttacgggaatgtgggtgatcccaaacagctgtgtcactgaaaggcttgactccagcatggatgacaatgtccggatgccggacagatggcaccccctctttagctgacgtttccctgccgtgcattctagaacttgatgagactatacatagttgggaaacgcaggaagaagtgtatttactacccttctacccttcctaccctcccccacgagggaacatcaacaggcccaatcctgggggacagtcacacctgtcctgagtaagatggcaatggcctttatgctcagaggtcagagttccacagtggtgctttagcctggtgagccccaagtcagccttggggatctgatagagacacagatggtgagtccttggtccatggtggggctgggagagagagagattttccagcaagccacggactgcactgtttggatcaagggccttgagcagggctcccaatctttcccgcccaatggacacttagcaatctgtgaccagtcctgatgcctacctctcactctaggcactgatttaactgatgtgtgttataacctaggctttgggtttgttagaacttcccaggtgacagacagcagagtttgggacaagctaactgacctaactgtctgtgctcatgaagtgcagtttgaccctggagtatggtttgtaaagtctgccctgaactaccattcctcagcagcagccttgcactgtagacaaccagaccatgtcacacctgactgccagcacacatctgtgacatggtcccagggttatttagttcctaaatccttgcagatcatgttattattctgggtcttcttctcagtttgcagcccagtagtgttgatggttgactcaaggggttcatccatgctgaaagcatccctgatctgaaaatctaatctgaaatgacccaagaagtgacagcttttgagaagtgatatgacggcacaagtggaaaatcctgcacctgactttgtgtgatgggttgtagctaaaatgcaggtgtacttaaaatattgtataaaattacgtttggcctcaatggctaaggcacatatggaatataaatgaatgtcatgtctagacttgggtctcattctaaaagagctcattaaacgcctacactgaaatgcttaaaaaataaaatagttgcttttctattgctgtgaagggacaccgagaccaaggcaacctgtagaagaaagcatttaacttggagattcatggttccagagcattagagttcatgaccaggaggtggggaacatggccacaggcaggcgtgtgcatagcaatagccgagagcttacatgttgagcaataactactaggcagagagatgggaaggagagagacccaactataatggggcaagacttttggaacctcaagctgacccctgtgacacacctcctctaacaaggccaccagctaggaaccaagcattcaaacatatgagcccatggaagccatgcaatgtttaaaccgccacaccagcattttgaagaagggaaactcacctgtgttgaaacatgtaaggattgaatggaggagctggccaccacatagtgtgctgtggccccatttttccagagtgtaggacagcaggggagacagcagctgtagatgtctcctgcttaggtcagtgcagaggatgctgggtgctaaagtagaggcttttctggttatttggacaagggttaggtgctggccattctagatattgaaactcagtgtgtattttatctacctttatgaatgagcaatgttgttggtcttttactctttgctttttgggctcttggggaggggcttgctacccagctcccccagaaaatcacacagagatatttttcttataactgcccagccttactttggcttgtttcttgccagcttttcttaaataatcccacctaccgttttccctctgggcttttatcttcccttcttccgtatatcttaccgtcttactccttggctgaccgtgtggctgagtggctgtcccctgacgtccttctctccttctagtttgcttcttctttttgtatgctcttcctgaaagccactcctgtctttctactgcctcactgttcagctctttattagaccatcaggcgttttagacaggcaaaaaatcatggcttccgacttaaacaaatgcagaataaacagaagccacacgcctttacaccattaaacaaatgctctacagcataaacaaaagcaacacggcttaagataatattccacagcagagcaagaaccttgacgatgagtttccctgaggcgtttagcgtcttgtgttctctttgactctaaaatgtttactttgggttgtatgacatatttatgtcttagctttaggctgaatactaagtgaaaagcctttttattttaatggcaccatgcactcttgttgaagaaataattggattaagagatgaggtgtggagaaggggccgtctgagtggaaccgagctctaggcgccctctccagcatctgccatggcgtctacacagataatttttgttactcgtgactcaaaacatggtcaaatgtgtgactgttgctcttggaggacacagggtgtgagtcctgtgaactcctggttgaaatcacctgccaaccttccagtcagcacacaagcttgtgtgtgtgtttggtagacaccttgattcttcacacaacaaatagtttctttctttcctttttattttattttgtttttaggctggagagatggttcagcggttaagagttcatactgctcttttagaggccctgagttcacttcccagtacccacatagggtggctcacaacctcctgtaactccagctccaggggatccgatgcccccttctggcctctatggacactgcatttaactatgtacacagaatttaaagttttgaaatttaagttagcatacacagtgatggcttcatgatggcgtcttcctgtacatgtcaccagactttgtttgtattcgcctccccaactccactcctttccctgtcaccctggcaattgttttaatcttcttacttagagcccagagtcggtgcttccgaattaaatagcaagaccagaacaaaacccagaaatctgagaagtgtcactaagagaacatggtgtgaagtctgagttagaacctgagcagctgcctgctcagcctcatattggggatgtgcctgtcgggctgctctgaaccacttatctatttaactgctctaggtttgccctcaatgggtacagcagccccatgatttaggggctgtcagtacatttaggttggtagctgtctggggacagaataaactagttactgctgaccgcacccccagtgcaccagtgaggtcttagaatttgcattttgacaaggttcctggtgacactgatggcccaggaagtgatggccgtgggctccagagaagtctgaatctaagaattttcatattccagacaagatcctgagacggttactagtctatgacatttactgttcacaccacacatggatctgctgaatatgtcaatatgcaaagggtgctaattaaacatattattgtctgtgtgtgtaggtcagaggtcagctttgtagagtgggttcttgccttccatcttcagtgggttctgggattgaactcatgtcctcatagttgcgtagcaagcccctttggcctctgagccctcttgccagcctgatggggggaatgtccttctgtatatatgtttttcttactggttgatgaataaaacactgattggtcagggaggaaatataagcagggctaccagacaaggagaattctggggaagaggaaggcagagaggagccaccagggagacaccacatcgtagccgccaaaggagtaacaggtctgggccttctctggtaagataagaccatatagaaatgcatagattaatcgttacaggttagtaattaagagagagctagccaaataaatgcacaagcaatatatcaccacataagccctccatgcctttttatatcatttgcttttaggaactcctatgtgcggctaaggcatttgtgcaccaatacttgggtaacgagcaccagcatccccatcgacacggaggaagagaggcccgtcatgctgaaagtaagtgtgccccgactggttcacctgctgtgcacacgggactgagagtgactgacagtccgtcttgcagggtgctagaactggttgcagctgatttcgtgggagtgaacatctgccagttggttaggtctctgacttgggtggctgcagcagggctgttggaggagggtgggtttgcagacatcaaaaaggtgcaggaggattccaggggcaccttctctgcttggaagtatctgggactgagggacatcgtgtgaaagaaaccctctttgggggctcttcaagaacagggaaggaaagccgggcggtggtggcgcacacctttaatcccagcactcaggaggcagaggcaggcggatctctgtgagtttgagaccagcctggtctacaagatctagttccaggtcagcctgctgaaattacatagccacagagaaaccctgtcttgaaaaaaccttaaaaaaaaagagcagggcaggaattgggcacggaaagccatcgtgtccccgaagcccttcattgtggatggtgttttctggagtttctctgtcttgtccacacccaccccagtggatcttactctgaggactacggtctctagagactgttgctgtttaatggaaacacatattgcagattggaacctgccagactaaggaggacaaagaagcctttgccattgtgtgcgtcccactgtccgaggtccgagacttagacttcgccaatgatgccaacaaagtgctggcaaccacggtcaaaaaactggagaatggcagcatcactcagaatgagaggaggtgagtggaaccaaatgtgacgttgaatcattgagagtcaaccgttggcctgggtgtgggggtgcaggctcacaggttctgtaactgtaggttgaagggacatggcgccctcctctggcctccagaggcactgcacacacatgcacacacacagatacacacacctaaataaaaataaaaaataaaaataaactaaaaatgtcagatggaatacttacttttcccattttatcttggctcaaaaatagatgattttagtttctctctgctctatttttgaaagctttttaaagactcacaggaccatacttgatttggtgtttagatggagagttttatatttcctggattcatgacatattttgcatgtaattaccatgtaatttttttgaaagtgtattctctgcttgtgtcactcagagaaactggaccatcgattggttattcatttatttataaatatgcgagaaatggccatttgtaatagagatcattgtctccacctcgtgccctaagccttcacacagcccttcagtagctattcccatcctgcctaaagcaatgggggttaaactccacctggtaaaattacatgaatcataagtgggggatccagtcatgtgatcgacagttgggtgctcccaggacctcagagcaaagacgtctgccctcttccctcttcatgacctgctgcagactttgatcaataaggagccatttgccacgtgcattccagctgtcacctgcagccatcgaaatggcaagccccccaccaaacggcccagacagaaatgcatggcaaatgtagttgttgttttgtttctaactcttaattctttgctcttttgggggggctgacacccagctcccagataagcagtacatggcgttttattcttacttatgaatggctggccttggcttggcttttttctagccagtttttgttaaactaccttaaattaacccattcaccttttgcctctgggctttgtcctttccccatttttgtgtatcttcctttacttcttactccatgtgtggccggctcctcaagttcttctctcctccatttcttgtttctcaatctgccctcccagatttctcctcctatttattctctctgcctgacagccctgcctatcctttctcctgcctagctattggccgttcagctctttattagaccaatcagatgttttagacaggcaaagtaacacagcttcacagagttaaacaaatgcaaaataaaagaatgcagtccatctttgtgtaattgaacaaatgtcccacagcatagacaaatgtaacacatcttaaaataatattccacagcaggcaaagtcagagaagggagcactgtggctcactggtgtccattccccagctgggcgttctggaacatctatctgttcaatagaatccccagaacagaagggcagaaatgtccagccttgtctacgcacccccaactgaaagccgtcatgtttgctgtagttgaaggatgatatgattgttctgtgctcacacaatgggatagcacatagccagggtcaggaatgaactagaccatgtgtgatggtgtacatgactctgacaagttttggattgagtaagaaggaaacaggatggataaacccaccattacactctgagagtgttctgtcactaaatgtatacattctggagacctttacacacagcccatacaataaagtcaaacattgtcagtgtgctgacagtcaaacggttctcagcctcctctctgtccttactactgcttttcctgtggggagcctgcatttgacaactgcctttagacatctgccctgtggtggccaacaaaccaaggccagaagcagaaaccggccactcgtatggcctcatgtgattagagaccagggccagctcacaacagaaatgttccagtgtgcagatggggtgtttccctcttttgcctcctcttgatgaatccgtttctgtctgtctgtctcctgcattcacagaaagttacacacttctctacgaggtctcctttggtaaactccaagtatctattgagtgctgggcctctctgggtgcttctctctccagggccttctcccccagtgcttgttgggggggactcagcccctctggatatgtcttaggaggacagtggattaggatgacccttgaccctatttttattttttatatcccctgcctctttctctcttcactgctttagtggagaataacagcaaggagactatgcctgagaactgggaagttacatttgctgatccacccttcatcctgatgcagtccgtgctgcagagtggtgaaggggctcttagtctctcagctttagaatttaatagaaaattctttctgagaatgactggcagccttgacacccttccctctcccccatggagagtgaagttattattagctattctttttattcaaaaccaaggtcaaagggagggtttgagaacattgcagacctgcctctgaatgcctgtgatgttggattcccccccccccacacacacaccgtgctatcctttagttgacccaggaagggactctggatgcaactcctgccaggctcagcatcctcagctttcgatgttttcatttgaattttctgtttgtattctacatgactgcaccaagtaagcagagcattagaagtgtgtgccccactcatgacgagggagggccatgaggtgtcagctgctacctggagcctgggaaggcactgagtgcaagtcttacagtctctgtaccacacaggctgcacttctgaaggacctggtttgtccacagagggtccgttgtcacagctgtacacacatgtagctaattccgtgagactgagctcttgttatgtgccaggtgctggccacacagactgtgctccaagtagctgcaaaagccaaggtcattgggctcttgtctaaatgcagctaggggctggggacaaggctcaatggcagagtgtttattcagccagccccacgccatgcgacacttgctgccaaacccagcaccttaagaagaccgccatgccttcaggcaacaaacagagctcaagggctcttaaaactcgtcatatgaattatggtgcccctcccccttcctgccttctttacccccttcttctacctctcctcctctccctccttgtcttcctcttttactccttcctttcctctgcccttcttccttctctctctcatctcctctccccagtcctcccttcctttctctttggaggccaggtctcatatataacccagcgtgtccttgaactctctatgtagccaacaatgccctcgaactctttaacttctcttttgtaatctgcttttaaaaatctctgtacgctattgtctgtatcctttggatactgtcttataattgctaattttcttataacctggacttttattagatgattttatatacactttttaatgctcagatttctgctggttctttgcctacccatttagtcttcattcatatctactatttaaaattatatatacgtatgtatatatacatatccatatatatataagtggtaagatatatatatatatatatatatttatatatatatagtagtaagttctttatctgttgaggactgacaacacactcatttaaatgtcatttaggaatggcttcattgcttggatcttattggcgatgaatatcagccttctgatttttagccccgatgttggctgtctttcctaatattggttttctgagtgttttggaatttaattacgcgggcttacctccgctggaacattatggctttttctctctgtgctcattcgttttctgtctgctggcgtggcctccagctgcctcctctcggccagcccgcagcgaggggtcagtgtggagggtgcgtgagtcgtggttatcgcagctgggacagcagctccatcagtgtctcctgtcccttgtgcaccgcctggctgcagcccgtgcagggacgttggaggctttctgcaagggggaccttctccatcagtgccttctgcaactgcagctgggcccatccttccagcagggctgcatcatccttacgcttggctgagttgggccggccttttatatttccctttaaatacggaatgtatgtcttacctaacttcgctaaacccgacaggaagtctgttgcctggcttttcttaggggcgtgtgaggagatgcacctcagatagggaacctatgtcagaccaaaacgcgtctcacctggagcgctaataacaggaacatgggtgaggggtgacttacaggatcgcggatgactcaagaggcggctgcacccctgacagctgccccagcagggacggtgacgcctggcagcccatgggccccagagcctctctccccagcctcccccacggtctgtcctagaacccggggcagcagtcttagccctgcaggcctcagcctcccaggttttgtttttcttcctcagtctcatgagcctctctcctccctccagagtagcatgtttgaatttggaggaattgctttaaagtaagtcacagagaaaatcaattattagataaaagttagcaagatggcatgtgttacagggtgataaccattaacagagaattgaagtttgagtttagctgacaacagccagcaggtgattttattgttgtttgctttttttttttttcttggcacatgagtaaacaagtaaagaggaagcttggtgtcttgctaccaacctcatcataaccagaggcacctctgtatgtagacagaagtttccgtgctgcctggtcctgcagccagccgttctgtcccaaataaacacaaagaggccaatattaattataaactgtttggcctacttctcaggcttattaccagctagctcttttgtcttaaactcacccataattatttttttttaaagatgacaaatttccaagatgtcagaatattttttttttttagattttatttatttattatgtatacagtgctctgcctacattcacacctgcaggacagaagagggcaccagatctcattatagagggtcacgagctgttacgataaatctttccaccaaaagccgcctgagccccaccgccacttgtgagctttacgccagccgcctgcccgagttagttccaaatgaatacacagaaacttgtattaggttcaaagctgcttggccaatgactaggattcttcatctgttagcttagtcttaactatcataaacctatatattttataagactatcttatcggacgccttttataggcgtccctccttgccggtggatcacatcctgccactggagcaggagcggaggggaaaagagggctcttcctgtttctccttctttaaatatgagtctccttgctatgtcacttcctgcctggatcaccacttctctactacatttcccagaatcctctttgactcctagttccgtctaacttgctgtctcattggccaaacagtattttatttaacaatcaataagataaacatacacagtagtacattccccatcaacgagcccaccatgtgggtgctgggaattgaactcaggacctctggaagagcagccactagctcttaacctctgagccatctctccagccctcacccataattcttatctatgtttagccacatggtgatttggtaccttttctcagtaaggcattctcatcttgttttctctgggtctggctggtgactgtgtctctgcttttcctcttcccagaattctcctagtctggtagcctcacctatacttcctgcctggctacttgccgatcagtgttttattaaatatgagtgacaaatctttactttgtacaagagcattgtcccacatcatctgtatattaggaataatgcatagtgacactccatcaagacttaatattcttgggctggagagatggttcagtggttaaaagcatttgctgttctcccaaaggacagaggttcagttcccagcacccacatggcatctcataaccatttgtaactccagctccagggaatgctccaggggatctgatgccctcttctggcctccttgggctaaacacccattttatatgtttcattttatatgataaaatgaaaagtaagaaaaattaacattctactcgccccatcaacagttaccattttaaagagtaatccagagtcacgacacaactggaccttttgttgtttgtgtctaaacacctaattccagttgtggagtcaacaagagaaaatgtgttgaagctaaatgttctctgagcagccatcagtgagattctgtctcactttagcccgctgacattacctggcgtcagaggtttgctttgacaataatatttgggagacattaaatcacagttgtgccgtcttccgtgcccatttgttcttgagactcataggatttttatttaataaccatttgcaatatttgattagaattggaatcagagtggagggcagggggaactggataggaaatgtcaaaattaagtagcaattacattagatattacattttgttgattatgttttcttaaaagtagtttaactttcttagtgtttcacttctcagacttaatttccgatagttcagaactgtctcatcttttctctgtgataggtttgtgactaagttgttggaagacctcatcttctttgtggctgacgtgactaacaacggacaggatgttctggatgtggtcatcaccaagccaaaccgggaacggcagaaactaatgagggaacaaaacatcctggcacaggtgagttgctttgagaaccaaatttgcctatttttttgttttgagttacagtgtcagttatgccttgctgcataacaaatgacacctagacacttatttcagtttctatgagctttaaatgtaagagcagtgtctgaggggcatcctcagagggactgtcagtgtgttatgtagggctaccgtcctctcaagacagaatgagaggaggtccacttcctagatggcttgtagagttaggtgcaagtctgcctcaggatacagcatttcctctggtgatggttgtgttagctttctgtgacaatggttgtgttagcttcctgtgatgatggctgtgttagcttcctgtgatgatggttgtgttagcttccagtgatggttgtgttagctgaagtttgatggcttgagaatcaccgagagacgggctgctgagcctataaggaattaccctgactatgctagttgactcattaggaagactcattaactgtaggccagcccaccctctgggtggagatcccagacagcagagaatggagaaagatctgagcatgcattgggtgctctctgtgcttggctgtggacagtgacagcagctgctgggagctcctgctttgctttcctctctgtgatgagcttcagcctcacaccaagacatttcccttaaaagcaacggattccagagaagagagagggcacctagacatagccatagtgtaggaaaaaagggccagccaaagacacacactctgagcagagccaaagaaacacactttggtcctgcaaccagagccaaaaaaaaaaaaaaaaaaaaaaaaaaaaaaaaaaaaaaaaatgaccctgaaaccagtgcccaagaaacacactttgtccctggaatcagaaccagtgaaagaaatacaccctggccctaaaattagagccaaaaggctaaaaggaccagtgaaagaaatacactttggccctgaaaccagagccaaatatgaccctgaacccgagcagaaaaccaaccaatccctgagcatgagatctaggcaatttgagctcagggactgaaatctgaccaatcctcaccctgaaagtcttcttcctggaaaactccacccctaagaagccctgtataaatcctgtgcctgttcagcatgtggctgtttgggctgcccgactgtcctcttccactctgacacaggcggccactctcctggattcttccctcccaataaatctcgtgaatgaggtttcggtgagactgtaacactcagttttccttggctccagagtgccagaatacctttccatcagagccgtaatgcttatacatagtctttaaaacatcaccatagatcccatatccatcagttctgtgtgactggttagaagcagagagagaatcccacagggacatggtcggcagaagttagggaccatttgaggctagcttagaggtacccaccacacatctccaaaataccggtgtggtcagagcatcttaagaaacaaattcccaggtgactttggaactgttctacctgcttccatctgctctaggaagacagcagtccagtccagatctctgaagtgcatgacacactagtaaattaacctgctttccagtgacctgcatggacatccctgtagtcacatctttttattgttttatttgctacttaaaacaattagcttctgtatcaaccacatatggataattgaaaacacaaaaatgacattagtttataattaacattaactgctgggtgatggtggcgcacgcctttaatcccagcacttgggaggcagagtcaggtggatctttgtgagttggaggccagcctggtctccagagcgagtgccagtacaggctccaaagctacacagagaaaccctgtctcaaaaaaccaaaaaannnnnnnnnnnnnnnnnnnnnnnnnnnnnnnnnnaaaaaaaaaaaaaccaacaacaaaaaaaaaactaacatactgtgctgagctggggaaggaaaaactgaagacccgttgtcagctagtatctatagactgtctgaagacagtgcttttcagaaataaagtctcaggtcttgttagactcccggaaaactcaagtatccagggtcccaggccacgtcttccgtcaccccaatcaccaggcggattcgagagcttgctgcaaactgcatgaggctttattgtaatttaacgagctacccccatgttagcccaggccttccatccccccgccatggcggatggctagcaaagacagtttgaagccgctgcgcacagatcttatagggcagggtggggggcatgtctaggggtacgcacaggctcaggattggtgtgcctccaggcttggagggtttgccctgtgttgattggtcaactggttgttatggctcttaggccctcccagggtggttgctatgctctctgcgtcattgctgtgtgcttgtccgtaaagctcacccagggtcgtaaagcacagcaccaccagctaacttctgattgtttccttgtcacgaggcaggcatctgactttctagtgtctaggacaaggtcatagaagcacgtgttcggctgttatggctgccaaaagggaagctggtcccttcagtctcagggacaaagtctttctgccatctataacgatatatctttccaccagctgcctgggttctgccaccgccttagagcccctgaataacacacagagtcttatatcagttacgttgctgctggacaatgactaggatttatttgttagctcagtcttaattaccaaccataactaccaatctatatgtttttataaggacttatcttacccagaactccagccttatgtgtcctctcttcctgggatcacatggagactctctccctttcctacatttcccagaatcctcctcctctcctagtcctgcctaacttgcttccctattggccaacagtgctttatttatcaaccaatagggcaaacacgtacacaggacaccctcattagtcatcagtgaattatttttagaaagcatttgatttcagggacttttaggactttgagtgaattatgagatattaactgatgtctccaacctttttatctcatgatacaaatataaaattcaaggttcagggaacatcaaattcttcttttcaaaaataatttttatttttaagaacttcacacataaacaccaactgcatttatcacatctgcaccaccctccccccctaacttctctgtcctccaaattcatgatgtccccttattgtaattattattatatgtacacgcacacacatgcatgtgtacatacaagggactgagtccgtttagccttctcatttgtgcccagtactggctgtgggaggcacaccgaggacactctcctaggacactgtcctctgcttctggcgcctacagtcttcccatctcttactcctccacgactttcaagacttagaggttggagacctgtgcagatggattgatagacttgggcccccagggctttagtctctgaattttgaccagttgtagatctctgtggcagtctccacctgttgcaaaaaagactctttgagaacaccaaaggctcaaagaaaaccacagtgtcttagttcatgaactccacgggacagttcctttccattttgaattcttatttcgaggctcattgtcttgatctcatgttcctcacagagaactaagcctgctggctcctcaccagaaggcaagaatttggctccctgggaatgggggaggggctgagggagtggggatgcaggggtggttccttgttaagacttcagtgtggatgcattcattcccatggccacttatctgcgttctgtgaacagtggacaaaccctctgagaaagttttgtgtatttaggatctctgttattgggggcatatgtatttggaattatttccttttgcctaaaaggaggtaagagtgacatttggaagtcattacctgttgtaagtttcaggtaaaaagttaacattttttaatattattttgattttggaaagttatagaaaaataacagaataataaaagcatatagaaaatatattttaattcgtgtgaatatatccatgtagcttgatacaaacaccttcatatttcctatcttaataaaatacggtttctaaataaaattaatcatgccattgatatagtggacttgttgactgggtgctctcgtgagcagagagtttttggttcgacagtgttttatttattattcaggactaacagccagttaagtaccttctgcctttgcactaatttcacttacacatttctacagtgcttttaagtccgtgttatttgttaaaaatgcgaaaaggttgcagagtgcacacgcgtgtccataaaacagaaggatcttcttcttctaggtgtttgggatccttaaagcgcctttcaaggagaaggcgggagagggctcgatgctgaggctggaggacctgggcgaccagcgctatgccccctacaagtacgtgctgcgcctctgctaccgcgtcctgcggcattcccagcaggactaccgcaagaaccaggtgggtagggagcccgcgccctggtgttggtggctgttaaagtatagaccgaggagtcagaactcgaactttgcaaagaagggctttatgtgggcggctcagagaaccgtccgtgagggctgttgagccggacaggagtttgacttgcaggcggggatgctgcgcttctgggcatggtcccggagggctcctgctgagcagggtaccctggcctgtgcctgggaggtgcagccttgctgtgtgcctgcatacctactaagataccatctgtggccaagattcaacctgcacctgaaacaggaggagggactgaggggaggagggatgggatgggggcagaggaatgcgatgctcgacgctcaggctggcgagcttgagtggtgggggctgggagccgtcttcatgaccgtatggaacatgcattttagggagacaggataatcggtttggttacttttcttccctgtgaccataaattatcgacaagaagaaactcaagggagcgagggcttatttggacccacatttgaaggtgtccagactgtcatggaggggaaggcacagggcgacccctcgcctcttggaagacaggaagcgagagcaaacaggaagttgggttataaaacccgcaaggcctatccccagtgacccacttcctcccggaggctctaccgggaggctcagacttccacaactcctacccctgctggggaccacgtgttctgatgcatctgcgcatgcaacagggttaggacatcaacaaggtcgccgtggtcatagggcagcctgaactgtggaggagagtgggcggcttgtgtgggtccagggatggagccaaaagctgtaatctgctagtgaaagttatttcgagtctcactttgtcttacaaatatgtagagagtctagagagatgtttcggtggttaagagcactggcttctcttctacaggacctggggtcaattatcagcacctacaaggcagctcgtgtccaatgtcccttccttctggcctctgttggcacttcaattatcagtgcttacaaggcagctcgtgtccaatgtcccttccttctggcctctgttggcactacaggcacatgggtgtacatacatacatacatacatacatatatgcaaagtgcataacacaacatacaggtcatctttaaaaaatctgtaatatttgcattgggttcaataatgcaaatgttgacataaagatatttatattattgatgacctggcattgtgttctccgtgtgcttcttatccagtagaaggatctgtatcactggtgtctaacattttttttttttttttttttccgagacaagagtttctctgtgtaatcctggctgtcctggaacttgctctgtagatcaggctggcctcgatctcagagctctgcctgcttctgcctcctgagtgctgggattaaaggcacgagctatcagttgctgagtttagttcatgagggagtatggcctgagagaaggctgggaggcagggcctgaggcacagagctcaaggccactgatgaggaggttcaaggcaagtgggcaacactcaactttcactcactttgtttcaagcctaacagttttcacaaatccactgagaccaagaagccaagcaggatgctcagacttacagtgtttttgttttctttctttttttttttttttggcattgggaaacaaacttgtcaccaggtgggcactatgacttagctgcaccctcagctgccaggctatggttttaagaatggatccagtgtgtaaacccaggttctgagtcatcgttgagagtttggaagtattttggcaagaaaacaaatttttgttttttccttcaggaagaatgtgttaaaatatgttggctttggaattcagctttcgagatttgaaaagaatatgtaaagcagattagttagacaataagtaaatctgttaggtaacaggaacaaactgacagtttaagcaggcccttacacataccatgtatttagatccatgtcatacaatatataatacaatgagcatctctcataccctccgggtgaggaacctagttctttgtggttgaaatgtggcttcgggggtcacactaatagtttcactacattccagtgggatgacagtgtagagagtaatgttcctgtctccccgggaaagggcatagatccagaatgctgaaacagacattaggcattggggttgtggcactggagacagtcctgtgcagcacccgactgtctgagcacagggtcggttggagaggcagctcagcgggtttcatgcctccccacttctcttcctgggtcccctgaatgagttacttttcttgtagctgtgatcaaagcctgtcaaggagccacgggaaggagaagttgtttatctgggctcagtttaagggcatcatgacaaggatggccgggtggcagcagcataagacagtggtttgctcacatctggcacctggtgttcagagtacagggtggggtcaccctgaaaacacccatcttcctgtcaagcagacacatttgaacatgtgcatatatgcgtgcgcgtgttgcacacacacacacacacacacacacacacacacacacacacacatgcctgggttgatatttacgcactctctagattccttgcagtgtgtcactgtgggtcatctatacctccccttccctccccagagctaagtcactgatctgaccaaagagcaaggtctccttggtgctcactgttcctgcagaatctcattgactctaagctatgtctggacccccttttttctgttctgttgaattaagtgtgtttgcattttctcagacccaaatgggggtacccctatcatccccaaagaccaagggaccatttcagaagagatgatgggaggattgtaacagttggaggccagggtaggagccctgtgaaatgctgtcttctggatatggcatgacgtgacacgatgtggtgttcacctgcacacagtagctgtgttatctgcatacggcctgcacacacaacaagacggggctaatcgggaggaagaagaggggtctgcaggggcgagcagcaaattagggaggccgatgaagcacagacatggtcacaatatccttcatacgtgtgtgaaactctcaaaagagctgaggatgcttggcattgagccagaagcagtgtaagatggtcttctctcaagagtgacccgtgtgaggtcactgaggagagttacctcaggcgtgtctgggagggtgtgtccaggtcttcaattgaagatgcaggatcttgccagtgggcggcaccacctgtctcatgggctggtaataaaaagagaaagtgagccgagccccgccccccccaactgagtgcaatgaggccaccttccctcccttgccctggcttccctccctcagtgaactgtatcccttgagctgtgagccacagtaagctttccccctaactgctgtaagtagcttgtgggaaaatattttaaaatgtagataaccaaagcaaattttagaattcctattgtccccacctgcatttcagacaccagtaaagagctcatgtgtgatttagtgctggcccaggtatttaacgttgtgtttgggtttactattatttagagaacccaatatcacctctaatttcatgtaattattcatcagcatcttggaagcttgcctcacactacagtacgaccccgatggccataaacgcgtgtaaatcaatatatagctctaaagtgacacactgcagaggacttttactttagttaattgactacccaatagcaaggcatcattccgaaagaccacaaaaaaatgatgctggcgttataattagatttgtgtaaccaatatcattttcaaggactaggtatgttccggtaaattttgctcaaggcaaaagccactttctaatcgatggattttctcatctgagaaacagaggtgcattcccaaggagaaaccccgagaaatagaaaacctttggtcattgaaatagaaaaccttagtgctaagggtctatctatacacagaatgagaaaaccagtgattgtggtttgggatataggagtgagaatgaagggtgagggaacaggctggagagacgacggctcagccagtcagagcactgactgctcttctacagggcctgggttcagttcccagcacccacacaggggctcacaactgcctgtaactccagttccaggatatctgacgccctcttctggcttctttgggcattgcatgcatgtggtgcacagactcacacgtatgcacacaaataataaatattaaaaaaaagaacagggagaagactaaatagtgcataactgaaactccccatagtgttctgtctctcacggttacaataacattttgcccggcgttggtggtgcatgcctttaatcccagcactcgggaggcagaggcaggaggatctctgtgagttcgaggccagcctggtttacagagcgagtgccaggatagcctccaaagccacagagaaaccctgtctcaaaaaactaaaaaaaattatatatatatatgtccacagttttctctaccacagggcctttgtgggtgccactccgttgcttggcaagcctctcctggcgctcccaaggttgctgtccttacctccttttcatccttgctcacacattgcttttttttctgcctccctcgtctccatccttggtttcatgtcgctcatccacgtgtgaaagcatgtctgtcttctcatttgctctcttttatctcatagcgtgatccccagagcttttgacgccatcatgaaacagttattgcatggctgaatctaattaataattcgagttaccatgtgatcctatttgattgctccttactgataagtatgtcaagtttttgctgtcacttatcagagaagatcttgttggtcattctagtgtcaatctgaggaaaacaaacaaacaagacaactggagcccatgtagggcattcaaacaatggctgcaccgatctcaagtcccaggagtacggcagtcacatacattttaaaaattattattattgtttattatttatagttataacttctggtgagagtcagagaggctccttgcaggctggtgaaattctaagttaccatgacgttaaaaactatagttagatttccttttctcacttacaagggtgtcagtacccatttagaaaatagtgattagtgacatgacttttaattaattaattagttagttatttgaagtattgaggatggaaccttgacccttgcacatgccaggtgagtgacctctcccaaagctctgccccagccctcggtcacagtttgagttacctgactgtggatacctttacttccctccaggaattctctttactgaggcgttatttacttgtttttcttctgacaagcttcggctgggttgtccggtggctcaggtgatcctggctgctgccccccagggagctgcgcttgcaggcagtgtgctccacaggttctgatgcctcctcctccctacaggaatacatcgctaagaacttctgcgttatgcagtcccagattggctatgatattctggccgaagatacgatcacagccttgttacacaacaaccgaaaactactggagaagcacattactgcaaaagaaattgagaccttcgtcaacctgctcaggaggaaccgggagcccaggtctgtgctctgggggatggaagaatggggtttttgttttgtttctttaagataaaaaaggtgagcatctattgtagcactgactcttggtgggcagacgaagcgtttatttccatgataacggtgtgtgtaaagcagttctgcttctcaggtgatcagcatcctttagagacactgttgatgtgtctccttggtgctggggagccaacctaaggctcacactggctagaaaagtgattggctgctgtacagcaccccagccctagactggcatttaaatgtactcatttacttctattcggttttccaaaatacattcatgtattttcacacctgtaatcccagcttctcaggaggctgagacaggaggattacaaggctagaaatggggttatgacagtgagtttaagaacagctagtagggccctgtcacagttgaggagttagcccagtgggagaatgtggggctcaaggactaatccccagtaatgcaagaagaagccagaagcccaaaatgtgttcacatagactcactcaggtgcccagattgcagatgtgggccacatgtgtcctaggagagatgaatgatgactgacacatttatgggccatggcaccgtgttgtggtgtctaaaggttgggcactcctgatggggcacttcatttaataatatacagtgcattctgactgctacctagattttaataaaatcaagcaaatgacttattatctatttcttttttggtgctgggaactgaacctaggggtgttcagttttattttcctttatttttcctctcacaattgtaggcctagctagcctagaactcactgtatagccggggttgactttccctctaaggcaatcctcctgcttcagcctcccgagtgttgggatgataaaagtgaccacacatttggggttacccagcttctaccttcacttagaaggagaaatgaaagacaagcaattagaaagggggtgccgggtcataggggctacacattctctttcactccatgctgccttagatggcaacagtgaacacagaagccaagaacacccactgtgctttctctgtctagtcctctaacagtaaaatactaggtggacagcggcctcccctttgaccaaccatcctctcttgaagggtgctccctaaccctgtatatattctgaagtgtgctccccaaccctgtcagttgctacttggttttggagacactcagggaggatgagtcattgtgctgatggatgtgcatcacctaaaacacagaagcaaacgtaacccattctgaacaaggcttatacgtaacagaaagaattgtctattctgcttttaatggtgcaggagacgaacagcacacaggaaaacacggcactgaaacaatgttaaatttagcttcttttattcaattccaaattacatttttgttgcgacgattctatgaggatgctttgtcgtgctggcgagatgctgttgttagtgtgtggaagcctttgccagggaagcctgagggcccacgttctgtccccagatgtctggtagaagaggacagggacacttggcacactctgtgatagcagctgtcacactagcagctgtcacacagcaagatgggaggaggaggcaggacagtcagcgggaaatctgggccaggtcaacacagtccagcagaagcaggagaccttgcctcaagacggaaggacagaactgacccctgaaagttgacctctcacctccacgaataccatggcttgccagaacccatgtcctgacatgggcgctctttaaaaattaaaaaaacaaacaaacaaacttaaattgatgagtggaggcactcaagatgctctgcttgcaaacatgaaattgttggagagtcactaaaagacaatctgttgaaacataaaaatgaaatgctcttttttttttcacgtccactttcctcctcctaggtttctggactatctgtctgacctctgtgtgtccaacagcaccgccatccctgtcactcaggaactcatctgcaagttcatgctgagccccggcaatgcagacatcctcatccagacaaagtaagctgcccacggaggtgtctgttggacatccctcaccacacgtgtgtgctgcctcatagactttgtgtgtctttgtcttccaggctagtgtccatgcaagtggaaaaccccatggagagctccatccttcccgacgacattgaggacgaggaggtgtggctctactggattgacagcaacaaggagcctcatggcaaggccatcaggcacctcgcccaggaagccaaggaaggcaccaaagctgacctagaagttctgacctattacaggtactggggacacgcgcactctccatcaaatatctgaagggagctggcgtagtttgtcgtgcctgggaatcaagattcgctagacccagtacaggttaaaaaaggcttattcagagagagaacacaacactggaggcaggcggctgccgcaggttctggctccaagcatcctcccaggctctattctgtccccaggtcagcagccagagaggaaaaccaacctaaaacctcccctcctgtacatacctgtgaccactcccaaatgggtgtggtcagcgacacaggtgcatagttaggtctttcatcacaaggttctctcaaacctctaggaattagagacgaagaagagggcacttgaaaactcagaaagagaggaatggagacggtcagggccacctagagatctcagaatgaaagctaacacatgtttcctgcttgcactctctgatgagttggggacttgtcagtaaggcgtttcttcctgttacctatgggaagtcggggctggtgagaagcaataggaccttgactgtggactgagggggaggaggcactgggatgagacagacgtggccacaggggtggccctcacagacatggcaagatgggatcttgtgagcgtgtgctccttggcacttgacaggtgcaggtgcctgtagttctggaaggagacccgtgttgattagcaaaagcaggagaggtggttcccaggggtcagtgtgttgggatcaataactgagccagagggctggcaagaggtctcagccagtggaaatgcttgtcacataagtctgacgattctggaggcaccacacccccacttcaacagaggcaggggagggtggagagaggtggcttcatgtgacttactgtccattccaggcctggtgcactgggtgttagggctgaaatcctagccatgagaggggttgtagtaacagggacagtgttagacccgtgctgtcatctgctcatggccaaaagagtttggctcagtgtcgtaaggacttacaaacacatctgcacacccagcagctggctgtgttgtgctttgttgtggaggggccttaacggaggcaagagggataacgtaacatgtctcatcctttaggtaccagctaaacctcttcgcaaggatgtgcttggaccgccagtatctggccatcaaccagatttcaacacagctttccgtagacctgatccttcgctgtgtgtctgatgagagcctgccctttgacctccgagcctctttctgtcgactcatgctccacatgcacgttgaccgggatccccaggagtctgtggtgcctgtccgctacgcccggctctggaccgaaatccccacaaagatcacgattcatgagtatgtttggaaactattttttaaaaattatttgttttatgtgcattggtgttttgactgcatacatgtctgtgagggtgttgggtcccttggaactggaggtagagacggttgtgagccaccatgtgggtgctgggaattgaacccaggtcctctggaagagtagtcagtgctcttaaccactgagccatctctccagccccagttagttgtgatgaaacaccatgaccaaagtaacccggggaggaaagggtttatttgccttttgcttcccgtcatcttcaccgttgaaggaagtcaggataggaactcaagcagagtaggaacctggaggcaggagctgataaagaggccatggagggtgctgcttactggcttgctccccatggcttgttcagcctgattttttaaagaacccaggacccgggctcacagggatggctccacccacaggggcctgcccctcccccatctgtcactaattaagaaaatgccctacagtcttgcctatagatggatcttagggagacagttcctcagtcgaggctccctcctctccagtggctctagctggtgtcaagtttacataaaactgtccagtacattgtatttattacttttctcatagctgacaagaaacagctttattgtggtgcacagtttgagggaccagtcgtcatggcggggcctcgaggcagcgtcaccttgaatcttttctcaggggcagaaagatctcacttctgattttttcctctctatctagtaatggtttcaatcccagggaacggtgctctccacactcaaagtgggccttccctcttcagttaattggttctggaaatatcctcacagatgtgcccagaggtgtgttttctagaagattctagatcctgccaagttgacagtgaggatgagtgttccaaagtcagcagatgaaagccaagtcaaagtgactttaactttgaaaagaaaaacacaggaagggatttgcccatttctgttcacagtgttcacctgggaagggtcagtaagatgccctgtcttgagggcaaaatgatagctcctcagcaggaaacgtgttcccggaggctagtaaacaaaagtcctaacactcacagctgagtgtgtgacacctggcagactccaccgcacttgttccatctcagttggcagtggcccctgccacagacaggatgtgtaccccaagaagttgactgatgtgtccaaggcagagcactgtgggagtatgaatagataacatccccactgtgggtaaggcaaagcactctgggtgtcagaataggtaacatctctactgtgtgcaagggaaagcattctgggagtcagaatagataaaagccccactgtgtgcaaggcagtgcaccctgggagtcagatagataacacgcacacttctcattgtttctcatcagcttaactcactcttgtgtcatctgcccaggtatgactctaccacagactcctccagaaatgacatgaagaggaaatttgccctcacaatggaatttgttgaagaatatttgaaagaagttgtaaatcagccatttccttttggagacaaagagaaaaataaactgacatttgaggtatttaaaaattttaaatattttctttgtgcctggtgcccacaggtcagaaggggacatcaaatcccatggaaccagatgatggagagccatgtgggtgctgagaaccaaacccaggtcctctggaggagcagccagtgctctcagacactgagccgtctcccagccccacttgaggtgttttaaagaaatagtcactcctggcatgattgtgtgttcttgtcagaaatgagatgcattgaacaccatagattttccttccctctgatatttagggtatctaggccgttgaattgttaggttcaggcagatacaaatctgtctgatgatgacaaaaatatagatttggcatctatattaacttacttttgaaactatatatgatgtgtagaaatgcagttcatatgttaattagaccacaatcaagtgatgtgacactctttgaatcataagagaaaagcttcaagtcacataacgagtccctgtcccctgtacaaatttgaaaaaaaccccaccttttcttagtgagttaggtgacatatgtactcagtgactagtaatgccttgccccagttatactaatggacaatagaattacaaataaaagctcattttattttaattcttgtatgccttgataattaaaatgttctatctcaattatcaatttattatagctttccttgttttatttttctttcatatatgtaaattttgttgtacttggtaaacagtgacagttttagatactttgtatttagatgtccttcccccatcttcacgggaatgatgagttagcctcattgacatgaattgaaatttgaagacaatgtaatagcaaaaccagagagagaacactgtcacaccatacctggtgtgttagctgtccactgtcatgagagatctcacccccagtgtggcagcccaaagtaaacttcagttctgcgagtcacaagcctgggtatggtatggcggtgtctgttcagtcactactggaaatgcttgccatttctgcctcgctcaggtggatgctggtggctctgcttctgtgctggcttgtccacacacctcagctgtttgccacatggcttttctgtgggctgagtgttccatgagtgtacctggcttcccacagagtgagagcaagaaaaacgagagaaggagagagtgagagagtaaggaggggagagagtgagagggaagtagagagggggagagggagaggaagagagaaagggaagggaggggaaatagagagagtgagaaagggagagagaatacttaaatgcagtgtctaaccttggctaaccttgatatggcgcagcatttctgctgaggcacacgccaatctgacacatcgtgggaggacagctgacattggagccgtgtcttggaggctgcatctcacttaattatttctctagtaccaaggaggccacaggccaggataggggacataaaactctgggccaatttatggctcacatttattaaagtaatttaaccactgattaagtggtatcttcctgacttacattaattaagtagtagatattgtaacataaactccttaaatcacattaaggcctcttatgaatagaccctagatttggatcagtcaaaatctgaacagcagcctttacaggggttttaaatcctaggtattaaagaattagggacttagaaacaccagaaccactttagatgtaaaaattgcaagtgtttattccattttccaatgctgttctgtcctctgctcttcctgtgaaggtggtccacctggctcggaatctgatatactttggattctacagcttcagtgagctgctgcggctgacaaggaccctgctggccatcctagacatcgtccagacccccatgtcatcgtattttgaacgattaagcaaatttcaagatggaagtaagaacttttgagaaatgtgataatgtttttgttattaattaggggtgagataaaaaagcaaacatagagaagcaatccacacaggcactggctcttgatgggttacatgataacagggtgggcattcaagcagtttcctttaataatactggtgtgtgtgtgtgtgtgtgtgtgtgtgtgtgtgtaggtctgaagcggacttcagtcagtgtccattttgactgctgtctactttattaattgaggcaacatttcctgataaactcagagtgcactcatcccggctactctaggtattgccctagggagccccttgactctgcttccaggagtgctggggctgcacagctactgtgcctgcttggctttgccatgggttctggggatctgaaccatcagacttttggtagtgtccatataataaccatacattttttggaatggtgattacattcagatggaaagttgtttctaggagttataagggagtgtgtatgctggacataaccctgtgaggatgtcagaggaggaggcttgggcagatgagcagatgttcagtactgaactgagacctcaggtcagcacgagttgtctcacacggagataagagggtcagatatgtctttgtggcagtcattcattagcttctggcttcattgtggaagaaggtgtgagacaccggggaagctgggataccctgcccaggagtcatgttgagtgacacagtgctgaagctgtcggctgggggaagggcctctgcacggagcacagtaatggccacagtagtacccaggacataatggaaaaggaaaaccagatttccaagttcaggcataaagagggactgtctgtctgatcagtaatttcaaatgagggttttacagaaaagctgaaggaatgaattgctgttaccccaatctcagtctctttaacatagcacacgcacacgctcgcacgtgctcacacacacacacagagacacacagacacacagacacacacacagagacacacagacacagacacagacacacagacacacacacactgacacacacagacacacagacacacagacacacacacacacacacacacacacacacacacaaaacatttaagtccttcaccttcagggcagcttgagtccctagtccagcaaagacttagttactgcagcagaaacagtgatggtctgaacagttattctgagagctccaactactaggatctctagggaaaattttgtgtagcttttacatggacacatgtctctttactctgggagcaggcactgatgacagagcaaagggataatcctattcaaatctagctcagtgaccagtgagttactgtgttactaacaggagtatgtgtgactcaaaaacttacccagcatgggcagctcaggcaagctcacccctggagctcccttacaacttcctggcagccaggcagaatggagccatctcccccacccagcaattgcttattgcatctataacctcagtgagggggtttatggattatgtaaagtttcagaaacttcctgagtcttgtgtgtttcatttacttcctttgtcctatgagttttcctcctctctctgggagggagtgtctcaatttgggggaagcatgcacacactgtgactgtcctcataggctcaggtgtttgaacactggcttcacagttgttgtgtcactgaagaagaatcttgttggaggaagcaggttactaggagagagcactgacgtttatggccaggctccacttcctgtctgtggagacgtgagaagttggtgcatcacgtttctacctccatgacttctccaccatgacaggctgtgcctcttcaaactgtgagccaggaaaaatccttccttccttaaagaaataaaagggggttgtgtgataatcaccccagaaagtcgaaataccgagagagtcacatagatgagaacacatagagaggaagggacctaaaagttccgggtggaggcttgggagcttctagaacgagtaagtctggaagtggggagaaaggggacagacccttgagttttgtgtgcagagagaacaaggactacgtgagtctgagcagcgtcacgtggagagagagagagagaggggggggggagcatgtctgtgccccctccagagccacttaagagaagtgtgctgagcgagctaagcttccacttccaggccccagagcaggtgagcatgcccaagacccttgacgcttaagccagacaaaatcccagcatgcagagggaaggtgggcacaaagtttcactccgagctgagaagccatcgatcactgacagctgctgggagagggacaatcatgtttctttgagggtgtggtccttgctaagttattcatgctctggtggatgttcccatacccaagtctacgggagaggtacaaattgtacttaatgagttaggaaaaattaaaggacatgaagttgtgtgtgtgtgtgtgtgtgtgtgtgtgtgtgtgtggcagatcctggaggaatttgtgggagagagaagaatatgatcaaaaaacactgtacaaaattctcaaagaactaaaaaaaaacaaataaacaaaacccccaacaacaacaataacaacaacaaaacaacaaccaagccagtaaagaaaaagaattctcttagagactgggagctggccacagtgccctgtctcttactgtaaagggggcattcggatcctcacactcatccatctaacacagcttattggctgggctgtcagtcagggaaagaaatactgttttcaagcaagggcattggctcttggccctttgcctagcatcataccgtcattcgctgtctgtgatttaaaagcgctgacggtggaactgatcgtttggattgaagaattgtttcaggaggcactttttttttctttgtcacacatagaagtgacaaaaaacagaagaacttaatggccaacacatgggacgtctggggaattatttgcaagtggcacatttattaaattatacaattgttttctttttatagcaaaggaagtacaatccaaagattttgttgttttccttttcatgcatgcatagtgtatgcatatggtgtgtgtttgcatgtgtgcgtgtttgtgtatgtggtgtgtgtgcatacatgtgagtgcacacgtgtgtgcatacgtatgtgagcacatgtgtgtgttcgtacatgtgtgcgcacacatgtgcacacatctgggggtgtgcagcatgtggcggcccaaggttgacgctggggaccaccctccattactcttctatcacactccttgaggcaggtatctcagtcaaacccagagctaatcagtacggatacggatgttctcactagctagcttctctgtggttctctctgccctctgaggtggaattatacctgacttgtaagtatttgatcccagatcctcatagttctgcagaaagcactttaaccattgagctttctttccagtcccagacttgactttctcctgatgctaatgataaaggctgctccacaactgtgggtctcactgcacccacccttccctcccctcattctcctcctcctcctctttaaaaaaatcatattcacgcatacatgtgctgcgattaggtcaaccccaccctcgttccattccagccaactccttacctatctccccagtttatctctcctaacattacgtgtttcctctcttattttgtttgatctttgatgttatttttaattaaacatttaaaattactttgcttcactctcccctttccttcttccagtccttcccccacacctctactctcctcctcaaattgatggctccttttattattgttgttatatacatgcacaaatgcatgcatttgcaaatacaacctgcccagtctatttagactgtcctgggtatatacgatttcagggctgaccacttggttgttggataaccaattagaggcttcattcccaagagaagctaagttatgcctccctcagtggtcactagttgcctgtggttctttgtttaggagctggaccctgtgtgatttccttctgtgttagcatgtttattgatgttttcattgtttaggtcttgtttaggaagccatattgttgacgtatcatgggtgtagcttccttgtcgtttctacacaatttcacagtagacttcctggtcctctggcccttaaaatcttcctgctcccctcttccaagattcttcctaagcctttagggcaggagttgtgtggcagatatacccactgggaatggcaccccacaatcagttgacctttgcaatttgaccgtttgtgtttttctgtgatagtatctgcttgctgcgaagagaggtttctttgatgtggggtgagacctacacttatgtgtgggtataaagagttagaaatcatgctggtctagtcaaatggcggtggtaggttctcctctgagatgcatgatatcactagacctgggtagtgggctctgtttctggtagatgggcatgatttcactcccatcgagcagtccaattagacagctgttggttaactccaagataaggataccattattgcatctttagagattgtcttacttttctgttgtcatgagataacatcatgaccaccacaacttataaaaaggaagtatttaatttggggtttacagttccagagggttagaatacatgactgtcatgcccagggagcatgcaattgggccggcaggcgggcgtgggcctagagcagtacctgagagctcagagcttatgtctgatccacaaatactaggcagagggagctaacagggaggttgcagtcttttgaaaagtcaaagcctacgcccagtaacacacctcctccaacaaggccacacctcctaatccttccccaaacagtttcgctaactggggaccaagcattcagatacatgaacctgcggggccatttttatccagaccaccacaggggtattttgccttgctggtcactgttatgatttacaggtgtcacaactgagtaggaatattgattgctttgctcttttaacagtttgtacagcaccttctagttctatgaaagctaggctctaggaggcctttgtattagatacagcctgaatcttccaaatcctgtgtccaaagtgtgtggtgtcttcagcaatagagacctaggatcttcaacctaggatctgtgcaccacctgctgaggaacccgttctctacttttctcaagtttcccaaggaagtcagtacagggcagtttgcatctacaaagaatttttgctttaacttgaggtgattttattgtatcaaaagtttaaaacaaacaaggcattgttctgtttccagtggttgtctgtcttgtctcaggaacagtgttgtttctgaaccacagtgttttaatgttttggaactggtgctcctccccttcttacagtccctttaactctggtactctgctatcaatcaaaggcatcctcttaaatttcactttctgccctttctgtagctcttgccatttctagagaatgatgacgcagctgcttacagctgtgcccaaatgccatcatctcatgagttttacctcttgctgtttctgaaatattactacacagtctcctgccatctccagtgagctgcatctatacctcagataatgcagtcatgcatagcatgctgtgttcggcaaatatatatgtgatcacatgtaagactgtgcatgctgtttagccgcaggtatacatcaggctgtatcctgtaggtttgtgccggtaccctctgtgatggttgtcccacagcacagttgctaaggatcatgctgtcatcgataagccttgctgccctttcctgtcttgctcaccactagaacaaacatatgtgacatgccttttgtgagaagtgtgaatcagacagacaaaactttttagagaccctaacttacaaatacatgtctttatttgttaattaaaaaaatttctaatgactctttggtcttgaagattcaggtttattaagcaaagagaacaatagtgaaatgaaaagctatgagaattggttctgtttctgattttaaagctgacctgtatcaggtctagtgtactaacatatacttatttgttttatacaaatatttatttagaacagttcacttgactatacataaattgtatgctgtccctaaatatacatacatttgcatattaaaatagcattccaaatatgatttgtgaaaattattaaatgagaaggtaacttagtaaagtctttgtcatggaagcatgaagatcagaatccccagaatccatgtgtaaaggtcaggtcagacatagcaatgtgtagtgttatcccagctctgaggaagctgaggtagctgagtctctggggctcactagccatctaacccagcctaattggtgaaactccaggtcagtgagaaaccctgtctcaaaccaactaaccagccagctaaccaagtaaccagccagtcaaccaaataaccaggcaaccaactaaacaaccaaccagccaattaactaaccagtcagctaaccaaccaaccaaccaaccaaccaaccaaatagctaaccaatcaaccagctaaacaaccaagcaactaaccaaacaaccaaccaaacaattaatcaaccaaccaatcaaccaaccaactaaccaaccaaccaactaaccagctaaccagccaaccaaccaactaaccaactaactagccaaccaaccaaacaaccaccaacaaaaagctggatagtacctgagaatgacacttgaggttgacctctggtttctataagtacacaaatatgtacagacttgcacacatatgtgcacctgaatggacagacacactttcacacacactggcacccatgcacacacactcacccacacgcttacacacatgtatgtgaatgcacaggcacatacaggcacccatgtgcacaccacacacacacaatgcacacacacacacacacacacacacacacacacacacacacacacacacagctttatgagctttctagacatacagagaatggaaaacaacatgataaacaaatagctcaaaacaccacctggtattttgtctgtctcaaaccaactaaccagccagctaaccaagtaaccagccagtcaacaatgctgctatgaacattgttgaacacatgtccttatttatgaacatgcattgtgtgggtatatgccgaagagaggaattgctgggtcttgtggtagactgattcccatttgtctgagcaactgccatactgatttccaaattggtcttacaacttttcactcccaccagcaatggaggaatgttcctttttcttcacatcgtcatgattctatttggccacttacacgacatgcttttggtcctttttgctgtaccattttaacagtctatttagatggccactgtcagtacttttaggaggactgacggggaggtgtacacaaagttcacaaaacgagacaaagctactctttatagctccctcaggcggggtttgctcataatcacggtgcagaaatttttaatatttttcagtcattttgagtcaatagatttttggaagatttactcatggttcatctatgtttctgtgagatgtgtcagaagcaaacaacaccacatgcagatttgagcccccggcccctcagctaagttggccagttcacagtggtgaagcatttcctcagctttgctgggaggagtttacttctgtctctgaagctgtgaggagaactggatgcctctggagctgttggagcgacaggagtgggtctaagcagcgctacacacacacacacacacacacacacacacacacacacacactcatacacacacacacactcatacacacacacacactcatacacacacacacactcatacacacacacacactcatacacacacacacactcatacacacacacacactcatacacacacacacactcatacacaccatacacacacaccatacacacacacacacacacacacacacacacacacacacacacacgattccatgtatatatgaaatacatgtctcctcacacctgaaaagtcaaacaaggaaaaaaaaggtaccttatgtgcgcatgaatgacacgagagtgctcaggacggttgctttggtattggagtgggggactttggtgggggattgactctagagggcgtgagggagcactctgggtggtgggaatgtccccgtctggacttcatgtggtgtactcctgcctgcacttttgtgagaaccctgcatacctcccatctgatgctcccaatcacagagcagaattgactccatgtgtggctcatctggccggctgggaagaattaaggatcagttttgcagattaaaatcctgagttttgcaataatactgaaatgtcagtgtttgacagtgatgagacggagcttggccacgtgcggtgcaaaatccttttaggtctccagtgtaggggatgggaagtaatttcctcccaagtcgtctgtgatatccagaggcgatgggtggtgacatcctcatttcctccctgtgactgtgtagcaatcactctgacacaagcaagcagggggcggggaggggcagggatggggtggggggtacggttatttcatctcatacttccaggtcacagtagttactaagggaagtgggggcagaaccatggaggagactgctttcgggcatgctgggatagttttcttatatagcccaggcccactgccctaggaatggtgtcactcacagtgggctggaccctcccacatccatcaacggtagagataaatgccacaggccattgtgaccagggcaactcctctttcaattgagactccctctttggtgactctagataacaggcagagaggacttaaaacaagacacaaattagctgtgggtaaatttcagttctgctaagtctcgagcttcctctaaatccacctgtgaataattgtcagacccaattgtgatttgtaactctgtccccgtggagtgatttatgagacagaaaacttaaatttagtttgtgcggcttcagtgttacacaaatgagacagggctcattggggcaacaaaaacaagagcgtcttcccaacggatcctttgatttcagggttctctcacggaattggggttccctctttaagtacttccctccttttcaatttctctttttcttttctccctcccctttcatacctccttccttccttttctttccttcccccccccttttttttttggtgagagggtctccatatagccctggctgtcctggaatcgctatgtagatgaggctaggcttgaactcacagagagcacacctgattgtttttattttaaacctaactatgatgattcccattttctctaatctttcaacatactatcagctcaaattcctgatgtagagttaattatctttaaaaaattgaaattctagggtgtttattttccagagaattaaaaagaatatgtgttaactgcttaactgaaaagctgaaaatgttagctaattatggctaacaagtagtgagaatttttttttcagcgttgagtactggtcactttggacttgtcttcaaagtctagaattagaaatttccttgtggtaatggatatgggacctcctgcacatctgtggtttgtgcagtggatatggacacactgtgtgcctgtgatctgtacagtggacatggacacactgtgtgcctgtgacttgtgaagtggacatggacacactgtgtgcttgtgacttgtgcagtggacatggacacacttgtgtgcctgtgatcggtgcagtggtcatggacacactgtatgcctgtgatctgtacagtggacatgggcacactgtgtgcctgtgatctgtacagtggacatgggcactctgtgtgcctgtggttttcacgggttgggttgatgttttttaagctgtagaagtccacggctttagcatttctcatcacaagtgaaaaatgcagcatctttgaattggagacctctgagttggccatacatggaaaagccaggagaattctgtggtccacatgccacaggcatgtgggagggtgggaatgcaccctcctatcttcccgactacatgtgttagacattaggatgctttttggcatctggattttaatttgttggtgacaggatctatatttggggaaagaattgtctgggctaaccttcttcccaacaatcatttgattaaatggttattttccatgcacatctaagtaagatccagacacggtgggtgcctcagactgctgtgtgagccagggttaaggttaacaaaggggcctgttcctcattagtgtgagaaggcgtccctcggaggctagcccataaacatactccacagtggggtaaaggtacagtgacttaaaaccatcactgcctgtgaccaccagcacacctgcaacacctggccaagatgggggctgtgcagtgatttgggaacaatggttgggttgtttgagagtcctggacaacggttgcctccgccttgcaattattctgctagaaagcagagggctctcacgtccttgagttgcagccacctctgtccagccttggaaattcctgttatgtaattttctaaccccctttttgttatcccagtcaccatataacaaagatttccaggacttcaaaatgaaactcaagatcatttctgcctgaaatatgcccatccgagaaatggccagtgctccatgcactctaaatcgtgttcctggaacatttccctttattgactcaggcagccatgcagttggagcaggcggtggattcaaagcggctccgtcttttaacggtgtacttgtgtatagctaccatggcgcactgccgtccagcccatacacattcctttagacatcttttaaattcttttaaaatttattatttgtgccttaatcctgtgagcattcccacagtttacattcttttatccttcagggttctgttgctctgcctttcattttcttttcttgttttctcgagacagggtttccctgtgtagctttggaacctgtcctggaactagctcttgtagaccaggctggtctcgaactcacagagacccgcctgcctctgcctcccgagtgctgggattaaaggcgtgtgccacattattccccttcttcttggctcacaccctccagatttctggaatgttctttgccagatgccgaggcctttccttcaggcagaatttcacaaacacccaagaccactgtttgcaaagaagggttgatacttattcttttgagtccagttgcttgttgtaggagctgggatgtaggaaacatggtgggacccaagtcttaagagtgacagggcgttccggtggctggctgactgtggaggtgtgggcgcaagatgtgttgtgtagtgtgtatggagaaaatggataccgagtcaaactcacgggatgacaggcagccgttcctcagtgaacacatttgtgcttgtcatctgtctctataatggcctcagataaggtaatgcttcctaggttctgaataattggatttctagtcagaggagataagtgaatgcaagcttattggagaatacagccccccccaccccatgagaagctttgatcccatgtccaagctctctttatgttatgagagccccacagcccttggtctgagtatggaatagggcatctgacagtttgtgcgctcttggtacccagccagggcctttccaccaccccgctgtattggtaattactaaaaccatgagttttgcaacagacactttattccctgggcagccagactccaatccttctcactaaggatgtggttcaaaggtatttattggcctaaaaaaaaaaaaaaaaaaaaaagggggtttgagatgtagggaagccacataaggaagtgtcagtatcggtggcccacacatgtgcaaacatgcttcggaccttcatgggaggcctgtttagaaaatagcctgtggctgggtctgccatccctgatgtcataagggttctcaggctgaccttcaggggcataagtgaagaggtctgctttagcgtttcgaaccaattaagatgatttctaagtctctcttaagaaacaaaacaaaaatcaactaaaaccattgaaacaatccttgtgggccacgctcagcaaggtgtttacagagcaacaggctgtgcagggcagagccttgtttctctgttacttaattaagtcacttctgaaagcaatgatgagagccagtgacagtcggagaaaccacatggtgaatttaggtttctctgagcttccgaagaaagcttgtgctctttgggttttaagccctcttttcttttgaagcaggctcttgtcatgttgcccaggctggcctagagcttcttcactctagccatccccctgccccagcctctcagggagggcaacaggcaccatcctctcttcctggtcctctagattttaaactttagggctgaaacattttataagaaagggataagagaaccttattaatttgcatatagggacttggtcacagtctttgctcccccactgctaatcgctgtatcttagagataaaaccattttctttttctggtttgttaagccattctacaacatggtgacacctactgccctttgcacagctacgtcctagcttttgtaatagccaatgaaaacccaaagatccccaaggtgcagcgagttacatgtgggggtgtgaggaacacagccaagtcctcatgatgaaattaacaagccgtgtcgatgccgaggccacccaggttttacgcgtgttaactcagtcctcttcttttgccaggcaacaatgtcatgaggaccatccacggggtaggagagatgatgacccaaatggtgcttagcagaggctccatcttcccagtgagtgtgcccgaagcgcagcccagcgcccacctcagcaagcaggcaagccccagtgaccaggaggacgtgacggtgatggacaccaagctgaaggtcattgagattctacaggtgcgtcctgcagctggactccggcggtgatgctgggccccattggtttctcttaagtgttgttgttgttgttgtaagtgtggtgtgagtgtggtgtgtgtgtgtgtgtgtgtgtgtgtgtgtgtgtgtgtgtgtgtgtggcacaggctcatgtggaccttgtggcaatcctcctgcctcagcttcctgagtgctgagattccagatgttaggcactgcatctggtttcactgtgtaaatgtattgaaacgctgtcggtgtcacgtgagtctgaaatgttattggtctcattttattctgaaaagctattgccccatcttcttattacttttaagtgaagggcagagctggcaatgcatcgcacaccatcgcttctttgcacactcgtcctgtggtttctgtcccttgaaatactctgggatagaatagctgatgtctagcagctgtggagtgctttgagcttggtaaattgctttcctgtgtgtttaatatcagctagtgttgaccccggttggatttttcttcatttaagagagattttttaaagcaggcatgtttaatgatgggattccaatcattttcctgctttcagttgcttggaacttgtttgtgaattccatgttttagatttcctgttgttatgggaaacacaagagttttatgtcagacatgttaggatacgcctataaatctagctctcaggaggctgaggcaggaagatttctgtgagttcaaggccagcctgacagtggaagaccctgcttcacccccaagacattatttaccagacttgttaattgttggttttattactttacacaattacctccctttgtgtttctaagaggctaaggatttttttcacattagcaaagtttaatacctacctttatcaatttaatgagctcagttatttcatgcagcagatccctatatgatttctagcatttttgaggggaggggaggtaagcctgggaagcaggcgtatggtacctttgttgtagtgtttataccagagtcagagaatggagcctgtagctttccggaccgccttgaggatgtgaaccgagtttccccacatctttcatcatcatctaacgtagactgagagctaccagaagtgggtcagcagtcctggcaggctccgtgcattcctcattctaagtaattagatttataatcataaaacatttcccagttcctccagggtttccaaaggccaagtcccaagaaatgttggcaggcttccccaccctgtgttcatggccttggaacttcatatgtaatgttttatcctgaagctgagaaagtactgaaggggccccaggtcagcctcacgaccccgtccatggcatgagggatgaccagtgatgcatgcggccccgttttcaaccgcggttttggcaatggtgcctttcgcagtgacagcgggaagtgtgctgtgtggctgagtctggctggtttctgcctccttccagcacttgaagaattcttttctgaaccgcttttgctgtctgactgtccacccagggtctcccgtttcaaggtgtggtgctgtcaatctgctgcctcctcagaacggccgttcatcaagtccttggtggccgcaggccctggctgctgctggctctctgccagctcctcctcctgggggggggctcccctctttacctcaccgaagaacatggttttcagtgagcgttattttgttcttgccctctgaccttacttattctctctgcctttacaagttcttaaatttatttttagtttttaagacaaggttcgttctgtatccctgaccgggccagagctcactgtgtaatgtaggccgatcttgaactcatgggaatcctcctgcctcagtcccccaggtgctgaggatgctgggattataggtgtgagccaccatgcctggcctttctctgccttgttgtcatctgctttttgttttttttaattttacactatctgcatcttcataatgagacacattagaggagcaaaggttgtgaaattcagttctgtgagttttcatctccaacagacgtgaatgcttcattagtgtttcgtattgaattctctcccccgccctttggacacttgagctttaaaaactgtgtattgagtacctgttgcctagccctgactctgtcctattcactggagtctcttcattgagcgtgtgttgtattcacagcaggttactaagagtcactgtggggtttatctttacttctggactttatactcctcaagagccacatttacaccctggccaccttaaagtactatgttaaaaaggatttttaacttctgtgtgtatgtgtgtgtacgtgtgtgtggtgtgtgcacaggaatgcaggtgctcgcggaaaccacagagtatcggatcccttggagctggagttacaggtggctgtgtgccatctgacatgggtgctgggaatcaaacttgagtctctcgcaagagcagcgtctccccagtcctgtgggcaccctttatacaacaccgtcttccttcctccctggctatcaaatgtggataaactgaagtaagaggagctgacataggctttcttccatcctgatgcagcaccttccaagtgtgtgttgggcgaggatgggtggagatggagggagagagagggggaaaggaaggggaggtatgaagagataaagataagggagagggagggggaaatagagagagggggcatctatccaaaccctggccatggaatcataagaagcgtcatacggacactttcagtgtcttgagagctcgctctcatgggtggagaagagactcaaggtgcagtggacgctgaagaaacatgaaattgcaacagaaaattgtgtgtgacatggtggccatgggccaaagtagtgtgagcactgagagagggggtgaggcctggggaggaagggagggttgtggaaacgagcagaaggctgctgagaacacagaagccagcttttctaaagcctgggctaccacattgtctaacgttcccagaaggaggaggccctttgagactacaggacactggtaatcgctatgctcagaaatccagcccatctcaggccagctgagatttgagcacatccgtccggatgtcttctctgatcccacggctcagccttgcaggtcatctcctaacacaggtgtcccccgttttcccagtgcagttacttgctccgtccaggaaggggttttcaatgtttgggttccccaaggctccctgcagagctcaggccttaagggctacttcatcgctgtccacatctcagccactgaggtgatgataacagaggagacacagacaccatggagaaacccaggcaccagcattccagccatcctggctgtccttgcttctgggcagatgtccccagggctggagcaactccactgcagttaaagctgcaggctttctgggcacaaaagccgttcctgcatctccctctccacaaaggatattgccagggtgtctgaggtcataccagcattacctcttcagacacacaagacgcccctccctgaagtgttcagagaacagtgtggggtgccagatttccttgtttctaaaactcgatgtagaccagtgtggtggcacacacctgtgatccaagctctggggaacaggagttcaagggtatcctctgctacatagggaatttgaggccaacctggggtacaggagaccctgtctcaaaaccaaccacccaaccaacaaaccaaccaaacaaccaaataaacaaccaaaaagaaaaaaaaaacaatcacaaattaattaattactgtgggctttcattagtactgaccaatgaaaacataatcctttccttcattttaaaactgaccaaaacaggtaaacaaccgagagtttatagtttacaaacaaggtctctgattggttcatttggacgattgacagcatggttgttggtgtgtgccacggcttgcattaaaaattcattatgtccacatgggggcacccatatcgcagtgtttgttgtggaggtcagaggacaacttgatggagtttccttcctcacaccttcacaggagttctggggatgcaacccaggttcccaggctttcttggcaagggttttgccctctgagctgtttccccagcctgcgtctcgtgtttaagcgccgtgctgctggctgcggcatcttagcagtgtggcgtctctcagcaccggctcatggaactaagcttgctatgttgcttcttccagttcatcctgagtgtcaggctggattaccggatctcatacatgctgtccatatacaagaaggaatttggggagaacaatgacaatggtgacacctctgccagtggatccccggacacgttgctaccatcaggtaactttgtgataggatttgctcttgcattttatgttctttttaaaatttatcttaaatgttacttttttttttctgagacagggtttctctgtattgttttggagtctgtcctggaactcagtcaatagaccaggctggcttcaaagtcacagagatcctcctgcctctgcctcccgagtgctgggatttaaggtgtgcgtcaccaatgccggctaaatgatactttttatttcttggaaatttcttgtatttatacaatgtattttgatcatatccatccatcactatctccctccaacccctgcaccccacacacacctcacctccctccccagttcatttccttgttttattgttattgacaacccttgaatccactcagtgctgcccgtatgaacatgggtgtgtgactattcactagggtatggtcaacctaccaatagccatgtccccaaagaagagtgactctctcttgctcagcagccttcagttgccaatatccacgctagagttttggctggcctggtcttgtagaggtgtccaaggcttctgtgagttggtgagtgtgccagccacactatttctaacacgggcatctcaaagcactcctctccctttatggactcttgcgttctttccgacacatctacaaagttccctgtgccttggatggtgatggcaggaggctggagatgacccattccagctgagcactcggtgtgatttagactgtgtattttgactggttctctgcattaaccttttcccacgcaacaagaagcttctctgaccagagctgagagcagtacaggtctatgcaatgatataaacatagatatcatgagctattgtgtaggcattaatccctgctgctgtgcaggcttcaggcccaatcaaaaggtggctggtcactcctatagccatcatgccgctattgcaccggtgagcacgtcttggcagcgtgtcagtattgacatacacagggtccggcacacagccaggtgagggttgaagtattttctcccctgggctctgatggggttgactgctctttgtcttgagtccaaagtcagtggtgtcttcagcaattgactcttgtcatttacttttgaggggcaatcaggagcaaacaataatctgtgttgttctgggtgcccccctgggcctctctgatgggtcaataactcacagggaggcattctgtgccttgcactgggttttaatttaaaataacccatgtttgctagaagtagcaccatctacccatgtgggggcttgcattcagattccatgtgtgcatgtgtgtatatacacacatatgtgtgtatgtgtccatgtgtgttgtctgtatgtatatatgtatgtgtgtggtatgtatatacatacatgtatatttgcatatgtgtccacatatgtgtgcatgtgcgtgtatatatatatatgtctatacacatgtgcattttcatgcatgtgtggtgtgtaatgtgtttgcatatgtatgtgcatatacatatgcgtatacgcacatgtgtgcgtatatgtatatacacacacgcatgtgtgaatacatatatagatatatacacatacgtgtgtgtgtgtgtgtgtgtgtgtgtgtgtgtgtgtgtatttaatcagcttacaaaacaatggattgccataagcttctttgtgatccttgattttgctctctgctttaaagaccccaggcacctttcatacctgtcttagaacaaaagtatttctatgtcagaagatgacaatctctcccaggtgaaactgagacagagcagtagaaagaggaacttgctgtttttggcactgtgtccggcacaggccaggtttttggcctgtccccatactgcctccactgtgataggtagaggtgctgttattacaaatttaacagatgataaaagtcagtcaggggagtgacttgggaagatctgtacatttgttagtgttgctgtgatgaaagcaactggagggaggaagggtgacaagcagttcagtctggaaggggcagcaaggggcggggtgcgaggtgactggtcacattgtctccacagtcaggaagcagggaaagttgaatgctggagctcggttcactttccccttttagcacaggaactcctgtggtggtgccacccacattcagggggcccttcccacctccatgaaaccttcccggataccctcacagacacagccagggtgggtttccatggtgattctaaattcaggcaggtccacagtgagggctaccacagtcatcaaagccccgggcccctgaggcctcttcagcgtcagagtcagagtcttttgcacattttgttcttttggtgaaaatctgagaacagtgttcatgcctggatcaaagagcagcgtgaagtgcagctggcagggcagggttttcggggaagccatggttagccggagaacaaaggggaagggctcccgaaggctcgcctgtggtggtgccaggctctgtgcctttccctcaggaatcccatctcacatttagacattcgaatgtctctgagacttggagcataacccaaagagcacagaaatggctgtgaaatttgaggctatagaaaggactttgtgaagactaagaaatgttagctcacctttttcctggttgggccaggtcggtcttggtggtctataaaccacatcttaggatatagacagccagttagcaaagctcttctgagacagcagtgcagataggaaactcctggacagtgttaggaaccacgtccttctccagccatcagctggtcaggcaagaacaggccattgcctgctagtttagtgagaatggggaccagaccagttgcctcgctacccacctctgctctgcgggcagccttccctgcagaccagcagccacccttccgcctaggcgaggagccactcctggcacccccaacacagcagtttcccagaagtgcagaaccccaaagggctgtttccaggaatgatcaggcagaaccagaaagtcatgctggcggctgcattgacagaaacataacagttactggctcccagaagccagacttctggaaatacaagctctgagtgtcagtaaagtacccaagcaaaggttaaaggcacgccagaaaatcctctggtggagtctctctctctctttgtctctctgtctctctctctgtctctgtctctctctgtctctttctctttctctctcataggatttccccctctatttgtatcttgatctcttttcatgctctagatatgagaaatacataatctatcatttgaacatgttgtcttagtaaaggtatcttcaatatggtggtggcagggcatggtgaggacttgtgattgggtcacatggcaaatgaccccaccccattctacaagaaaaagagaaggaatttcttttattttgagcttgtttttattgagctcctctccctttctcctctcttcttcccttctaccctccctctgcccccatgctcccaatgtactcaggagatcttgtcttgtttgcccttcctaggcagatccatgtctgtctgtctttgttacctaggttctctggagttatggactgtaggctggttgtcctttgctttatgtctaatacccacttatgagtgagtacatattatatttgtctttctgtgtttgggataccacacccaggattttttttttctagttttatccatttgtctgcacatttcaagatgtcattgctttttattgctgagcagtactccatgtgtaaatataccaccttttctttatccattcattggttgaggggaatctaggttgtttttaggttctggctattatgaataatgctgctatgaacataattgagaaaatgttcttttatcgtgagaatgcatcctttggtatatgtccaaaagtggtattgctgggtattgtggtaaacagattcccatttttccgagaaaccacagtactgatttccaaggggctgtaaaaatttgcacttcagccagcaatggaggagtgttccccttactccacatccgctccagcatgagctgtcatcagtgtttttgatcgtagccattctggcaggagcaagatggtacctcagagatggtttgacttgcacttctctgatggctaaggatgttgagcacttccttaagtgtctttctgctgtttgagattgttctctcgagagctctcaatatctgtaccccatattttcattagattattttgtagtttgatgtctagtttcttgagttctttatatgttttggagataagccctctgtcagatgtggttttggtcaagatcttttcccattctgtaggaagtcattttgtcttgttgactgtgtcctttgctttgcagaagcttctcggtttcaggaggtcccatttattaattgttgatctcagtgtctgtgctactggtgttctatttaggaagtggtctcctgtgttcaaggctacttcccactctctcttctttgagtgtggttggttttatgctgatatatttgacccatttggacttgagttttgtgcatgggggtagatacagacctatttgcattcttctacacgtcaacatccacttatgccagcaccatttgttaaagatgccttgttttttccattttataattttagccttttttttgtaaaaaaaatcaggtgttcatggttatatggattgatatcagggtctttgattcgattccattggtctacctgtctgtttttgtgccaataccaagctttttttgttactgtggctctatagtagagtttgaagtcagggatggtgatgcctccagaatttcttttattatacaggattgttttggctgtccttgttttttgttttttcatatgaatttgagtatcattcttctgaagtttgtgaagaattatgcttggattttgatggggattgcattgaatctataggttgcttttgggtaagatttctatttttactatgttaatcttacctatccaagagcatgggagatctttccattttctgatatcttcttaaatttctttttccacagatttaaagttcccgtcatacaggtctttcacttgtttgattagagttacccaagatatttaatgttatttgtggctattgtgaaggctgatgtttccctgatttctttcttggccctttatcatttgtatataggagggctactgatttgtttgagttaatgttgtatcctgtcacattactgaatgtgtttatcagctgtaggagtttctggtagaattttttgactctctcatgtatactatcctatcatcagcatacagtgaaagtttgacttctccctttccaatttgtattccctttgaatttttctccatttaatttgatgttaggtattggcttgctgtatattgctttattatgtttaggaatgttccttttatccctgatctctcaaaaacctttatcatgaaggggtgttggattttgtcaaaggccttttcagcatctaatgcaatgatcatgtgtttttttctttcagtttatttatgtggtgaattacattgatggattttcatacgttgaaccattcctatatttctgggatgaagcctacttgatcatggtggatgattttttcatgtgttcttggatttgatttggcagtattttattgagtatttttgcattagtattcatgagggagattggtctgtagttctctttcttagttgtatctttgtgtggtatcagcataactgtggtcttataaaagagtttggtaatctttcttctgtttctattgtgtggaacaatttgaagagtatcgttattagctcttctgtgaaattcaggcagaattctgcactgaaaccatgtggtcctgttttatttctggtggagagacttttgatgactctttctattattttaggggttataggtctatttaatttgtttatcagttttgatttaattttgatatatggtactcatccaggaaattgtccatttcctttaaattttccaatttagtggagttttgaagtatgacctgatgattctctggatttcctcagtgtctattgttatgtccccttttcatttctgattttgttaatttgggtattctctgtctgacttttggtttgtttatcttgttgactttttcaaagaactaactctttgtttcattgattctttgtattgttctctttgcttctattttattgatttcagccctcaatttgattatttccagccatctactcctcctgggtgagtttgcttctttttattctagagctttcacttgttctgttagttcactggtgtggaatttttccagattctttatgtaggcatttagtgctatgaacttttctcttagcactgctttcattgcctcatgagtttgggtatattgtgcagtcattttcattgaattttaggaagcctttaatttcttttttttttttaatttcttccttgacacattggtgattcagttgagtattgttcaattttcatgagtttgtgggttttctgcagttagtgttactattgaattctaactttaaaccatgatgatctgataagatacagggggttattccagtttttaaatgtctgttgagatttattttgttggtgagtatgtggtcaattttagagaaggttccatgagatgatgagaagaaggtatattcttttgtgtttgggaggaatattctatatttctgttaagcccatttgagtcaaaacatctgttagttcatctatttctctgttaggtttctgtctggcagacctgtccattagtgagagtgggatgttgaagtctcccactattagtgtttcgggcttcacgtgtgatttaagctttagtaatgtttcttttacaaatgtgggtgcccttgtatttggagcacatatgctcagaattgagacttcatcttgatggatttttcttgtgacaaatatgaaatgttcttcttcatctcttttggttacttttagttggaagtctattttgtcagatattaggatagctatccctgcttgtttcttaggtccatttgattggaaaaaatcttttcccaatccttttttttccagacaggatttctctgtatcgttttggagcctgtcctggaactcgctctgtagaccaggctggtctcgaactcacagagatccgcctgtctctgcctcctgagtgctgggattaaaggcgtgcaccactaatgcctggctcctaatcctttactttaaggtaatgcctgtgtttgtagttgaggtgtgtttcttgtatgcagcagaaggctggattctgcttttgtatccattctgttagcctgtgtctttttatcggtgaattgagactattgatattaagggatattaatgaccagtgtttgctagttccagttattttgttgttgtgcatacatttccatgctttgcaatttgctgttatgggattatcttttgcctgtgtttttgtgggtgtaactaatttccttgggttggagttttccttctagtttattgataggtattgtttaaatattgttttgacatggaatattttgttttctccgtctatggtgatggaaagctttgctgggtataatagtctgggttggcatccatggtcccttagtgtcccttagtgtctgcataacatctgtacaggaccttctggctttcattgtttccattgagaagtcaggtgtgattctgataggtttgcctttatatgttacttagccttttcccgttgtggctcttaatattctttctttcttctgtatgtttagtgttttattattatttggcgagaggaattttttttcttttttggtccagcgtatttggtgttctgtaatcttcttgtactttcataggtatgctcttctttagattggaaaagttttcttccatgattttgttgaatatgttttctgtgtctttgagctggaattcctctccttctactatccctgttattcttaggtccagtcttctcatggtgtcccagatttcctgaatattttgtgttaggaatttgttggatttaacatttcctttgtctgatgaatctattacctctattgtatcttcagtgcctgagattatctttttcctctcctgtattctgttgtttacacctgcatctgtggttcctgttcatttacccagattttccgtttccaggatttcctcagtttgtgttttctttattgcctctatttcattttttaagtcttgaactgtttgttgcctttgcctgtttgattgccttttcttggttttcttttagggatttgttgatttcttgttttttgtttgtctttccctccgtttctttaagggagtttttcatttcctctttaggtgcttctattatcttcataaagttgttttaaggctattttcttctgcttccactgggttgggatgttcgggtcttgctgttgtagagtccctagtttctggaggtgccatatgtctcttcatgttgttgaatgtgttcttgtcttcttgtctatccatctcttcttctgatcagcacaggtgcagcctgtgcttcagggcatccctctttctccagttggtgtagttgggggatgccactctgttgattgctcctccaggagcaggcagggctgagtcactgatggctgctcctctaggtgcaggtggttctgatgctccagaggtcactaacgctgctgggtgtcacatacagagaatggcactggaggctggatgggacacaggtgctctttcccagaggagcttcttactactgtttctggaagccaccgctgtcaatgcttcagcattgcccagttcatgcactgtctgctccctggttgtttgtgacctgcctgacccttcctctccccagttggtagggaagaaggaatttcaaatgtagaaaggtcacattgaaggaggaacagagtggctctttacatggattttaattccttaaaaaatgcttttcccttgggtctggagagatggaccagctgtcaagagcactggctgatcttgaaccctcattaggttcctgacatcttcatggtgtctcacaactgtatgtagtcccagggcatctgagatccttttctggcctctgtggacactgcacacaggtggtgcagagacaaacatgcaggaacagcatccacacacatgaaataaaagtaaaggagaaagaattgttcttctgtgccattagcagtgcaatattgtgtgtttttatggagggacacatgtatatttgacttatcaaatacaaacatacacacttagaaataagagtgcctttgctaagatggctgttgatcggttaacacatctgatggcagtaacatatagtgtaaataatataagcacagcttatattaaaggattgaagagtgagatagcacatttgtagcctggattcaatatatagcatctaaatacacacacacacacacacacacacacacacacacacacacacacacacacacacacacgcagaaactgcaattaagatgttcaagtttgttctagttttgtttttgttgttgtgataaaatactctggtaaaaagtagtttaggggagaaaggggtttgtttcagtctatatattcaggttatggtctatcatgacagggaagtcacagaacatgcccttgagagaatgggtcatcatatcatgtccacactcagtcatatcatgtccacgggagagagaagtcattgcacacatgcttgcttatttgtgctcagcttgacttctgtatagttcaggacctcctacctagggaatggtgccacccatggtgggctggatcttcccacatcaatgaacattagtaatcaagacagccccacccacgtgtctacaggctaacccaatatagacaattcctcattgtgattctacattatgtcaagttgacaaagcgccatcacactgattgagtggaactgtattgtaactttctgagctattaatgttcggtgtcacaaaaagtgttaaaataacatgagttaaaacaagatgaagactctccctgtgtgtcttcacagctattgttcctgacattgacgagattgcagcccgggcagaaacgatgtttgctggaaggtactgtaatgaatctttttatcttacatgcgagatacctagaattttgtttagtttgttatcattcatctttttgtgcctggttagataccccagttgctgctaacataatttctgccagaaatgaaggttggaatttactctagacaccttaaacgatgggagaaaagagatccatgtatttaacatcctggaattcttagcttttctttccttagatgatggcagcacacagatgccctctagctcccttgacagaaacttgttgtatcttgtaacacattacgtctcagagtcttagatctctgtggcaagaaagtagcatcttttgatgttatccttaactttatgcatgagaaaccaggcatttcttgccatttagaagtgtccacgatggaagaaaataaggtgtctgatgtgaccactctcctttgcttgccacgtcctggcatgtattgttgtcaagtttatttttcagaaatgaaacaatagcagtcaaaatgagaaagtaaatgtcagctagaattactgagattcatttttattacagacctgaggtaacctgaggagatagaactgtccacactgaactccctactgcctcttttttctcagagaggggaaaaagggggctggagagatggctcagagtttaagaaagggggaaaggattaataattaacataactgtaagatccacggtttcatagtagcctgggctacgtagtgagaatctgtgtaggggaggaggaggcgggaggagggaggagggaaggacagagcgcccagatttattgtttagtgaacatttggtatagctttatttttctactgttatgatttcctattgaagtattttattattctagggaagaaagataaatccagcctatgattttatcttaagacacagacatgaactgcttaatgtcactttggccaaagatggctccaggtgatagatcgatgaggatagaattgtgttctataacatggcaagaactgaaaaattcccagagacaagtgacttcatagccatcggttgttagattgcagtgtgttagtgtctgtggaggggcttgaggaaagcaccagacagccaactgtgtcagtgtgtggcgtgtgcagccacacgcagcatgcagtacttgagagtgactgttgctggcttatgcattgaatatatttttaaccattattttggtgtgtctgtatgtgcaggcacacgtgtgtgcatgtgtcagagtgtgtgtgcatgtgtgagagtgtatgtatgcatgtaactacgtgtgcatgcagtgtgtgagtgtgtgtgcatgtgtgagtgtgtgcctgtgtgtatgtgtgcatgtgtgtgtgtgtgagacagtgtatgcatgcatgtatgcatgtgtgagagtgtgtatatgtgtgcatgcacgtgtgagagtgtttgtgttcatgtgttcatgtgtgtgcatatgtgagagtgtgtgttcatgtgtgaatgttcatgtgtgagagtgtgtgtgcatgtgtgagagtgtatgtatgcgtgtaactacatgtgcatgcagtgtatgagtgtgtgtgcatgtgtgtgtgtgcctgtgtgtttgtgtgcatgtaagtatgtgtgcatgtgtgtgtgagtgtgtgagacagtgtattcatgcatgtgtgcaagtgtgagaatgtgtgcacatgtgtgagtgtgtgcatgtgtgcatgtaagtacgtgtgcatgcgtgtgtgagtgtgtgtattgtgagtgtgtgtatgtgtgcatgtaagtacgtgtgcatgcgtgtgtgtgtgagtgtgtaagtgtgagtgtgtgcatgtaagtatgtgtgcatgcatgtgtgtgtgagagtgtgaatgtgagtgtgtgtgcatgtaagtatgtgtgcatgtgtgtgtgagtgtgtgtattgtgagtgtgtgtgttcatgtaagtacgtgtgcatgtgtgtgtgtgtgagtgtgtgtgagtgtgtgaatgtgtgtgtgcatgtaagtacgtgtgcatgcgtgtgtgtgtgagtgtgtgtattgtgggggtgtgtgtgcatgtaagtacgtgtgcatgcgtgtgtgtgtgagtgtgtgtattgtgggggtgtgtgtgcatgtaagtacgtgtgcatgcgtgtgtgtgtgtgtgtgtgtgagtgtgtgtattgtgagtgagtgtgtgtgcatgtaagtacgtgtgcatgcgtttgtgtgtgagtgtgtgtatgtgtgagtgtgtgtgcatgtaagtacgtgtgcatgcgtgtgtgaacgtgtgatcagcagcatctcgtgccccttgtctcccaattgcatcatttctcatgtgctttgtttaaccttgtgttgctttgttcatcgagatcctagattccatacattataatctgtctgtcatgtatgtatcaatcacctacttacatgtctaaacatacctgccatttaacatctacctatatatatatatacatatatacatctgcctatcatctatgtatatccatgtatcttgtctatcaatcacctgtctgtgagtgtctgcatcgatgggtctgccatgcgccgtatacctgtctctgcgcgcatcggttttgcgtgtcggtcatttacatgtgcatccatctgctgcctgtgttctgtgtatctgtcatctgccatccgtctctttcatatccatcttcccccacccatgtaacccatacatgcattaacacaggtgtgtgataggctctgtaggcttgcgtcatgccctctgtagtgcttgcccaaccacagtcatctaagggttacatcccagagcacagcccggcagcagcagcacatgctccagagagatctttcaccccaggggaccctgtccccagtctcactgtgccaccaagcacacagagccccgtggagatggctgtgtgtttgtcactgtccctcaccgcttgccgtgtggtggtctcttgggctccaggctgttggtcgatattattgataaaagctttcgcagaaggcggctcttctagaagagtggcagggcaaggaggacaaagagggatagtgggaaaatttgaactagtaatgaactgttatgaaaatgtcataatgaaacccattattttatatgctaggtaacaatgaatcgaaaatgatgtagggatcacccagtgcttgtttttcctgttctctggtgattaactcttgagactgactgaggaaccttctttgttattgttccctcatcaattgtataagattaagaagtaacaatgtctcttcttttttgggaaaatgagggtttaagtttaaaaacacaggtataacttcagtgaatttaatatagatatcatgcgatgtgttattttagagtttcttttggttttacaggaaggaaaaaactccagttcagcttgatgatgaaggaggcaggacgttcttgcgggtcctcatccacctgatcatgcatgactaccccccgttgctctcgggggccttgcagctcttattcaagcacttcagccagagagcagaagtgctgcaggcctttaaacaggtgagctggggctgggtgcctgcttgccgagctcgctcgggctctgggttcagttctcagctctgtacccaagaaaacgaacacccgagatggagggccctggaaaaggaacacctgagaattcctggagttctgaaggtgtttgtagcccgtctgatggtagctgcagatgaggctgtgttccttggatcctctcttgctctgtagtacaggctggctcagaattcagttcattgctcggattgaccttgaactcttggcaatccccctgcctctgcccctggagtgctggaattgcaggcgtgcactgcaatacctggcttgttactttgtgttctgaaagatagatgtggtcctgtctgtgtgcctagacaggagctgcttcagaatgagtctcccacaggtgatcttcagtcagtatctttataaaaatgacagtctctagaatttaggaagtgctgctggaacaataacctattagaaattttgttgctgctgtggttattttgactacagaatttaatgatgcacctggcaagccatagcttcaaaataaatattttgtgattaaaaatggagaacatccaaagaaaggaactttaatgggggatccatcttgtcccctgtgatgggatctagtctatcttctgtgatgggatctagtctgttttctctgatggatccatcctgtgccctgtgatggggtccatcctgtcccctgtgatgggatctggcctgtcttctgtgatgggatctggcctgtcttctgtgatgggatctggtttgtcttctgtgatgggatctggtctgtcttctgtaatgggatctggtttgtcttctgttatgggatctggcctgtcttctgtgatgggatctgggctgtcttctgtgatgggatctgggctgtcttctgtgatgggatctagtctgttttctctgatgggatccatcctgtgccctgtgatggggtccatcctgtcccctgtgatgggatctgggctgtcttctgtgatgggatctgggctgtcttctgtgatgggatctgggctgtcttctgtgatgggatctgggctgtcttctgtgatgggatctgggctgtcttctgtgatgggatctgttctgtcttccgtgatgtttggattgcacattaatctcacagtgattacttgcaagtatgggtatctcactgatgttttgtgtttagtggagtgtgaacctgtattagcagttttgaagatgctagcagatatgaagatatagatgcatatgttttacatgtatgtgccatgtagtgtgtataaactataaattgtatggtggtctcaagctctgaaactgctgtttatactagcaaacgtatattgtaaccattaatattttcttccatgggtttttatactttgacttttcaaacagatacaagtctagagaaacctcagaaaaatgaacttgaacaatgaaattagagttagattatcttgtaaaagaagatttgtttactcttgatttatttatatgggtatttgcactcatgtaagtatatgtaccttatgtgttcagtacccatggtggccagcagagggtgtcgggcctccgggaactggagttgcaggaggttgcgagcaccatgtgtgttttgggaactgagtttgggtcctctgtaaatgctggaggtgctcttaatccctgggccgtttctccaacccccacaactttatgttaaattacttgtcagcattttggaagctttttgagagcacacatctaagaattccttttcgcgtgtgagcatattggttagagttcgtgaatacttgcaggaagattttcagacggaatacacataagtatgcgtaagtgttcgtaagtgttgaatttcatctagagagtggctgaagatgggatttcgggtgtgcaggagccagggacacagaaggctgggagagcgctctaagggtgaaactctcgtgtcctcaggtgcagctgctggtgtcgaaccaggatgtggataactacaagcaaatcaaggcagatctcgaccagctcaggctgacggtggaaaaatctgagttgtgggttgagaagagcagcagctatgagaatggagagattggcgaaggtcaggccaaaggaggcgaagagacaaatgaggtttgtttccaaggtcactttcaggaagaaaattacttatttctgattgagcgcttaattgaaatgtgtgtctgtgcaccgcgcctgtagtacccatacaggccagagggggcaccataccccccgaacgggggatacagagcgttatgagccgttgtatgggtgttgggaaccaaacgagggccctgtggaagagcagctgctctcttacctgtgtttaacgggggggggggggtccagcccccacttttttttttaaataaaagtgttactggtaatgcttttatgaaagccagttaccaccgaagtcctaattggtggtttctggaaagaagcttatactcctcaggagcatcagtggtgtggagaggctcactcagcacaggtctgggagtattgcttcgggttgtagattggcagcacagaatgtggcaattaaatattaacattaaacattagaaatgccgaggagttacgacgaggtggagttgaagtggtggcatcccacctcaggtctcaggatggtggcttatctgtaattcttcactttaccattttagcattagtggaatatagattttctagtccatacaaatttgttttatgatcagttagggccatggggtggtgacacgataaataaaagacccaccgacagatactggggttcaaacatcaagctgacggtcagaaaagcaaagtagctggccactatctctcacctcaagctcaggctaaaagggctgatccatgcacaagctcttcaccaagcctcaaactgctgcctttcctcagcgtggctggagaatactgagacttcaatgtcttcttgtccctcttggtactgagccttcctatcttcagtgtggctggagaatcaatgcttcctatccccaatgtgaatgcctgatctgagaccctgctcctggtttatatacctccctagtgctgggattaaacgcatgtgatcccaggtgctgagatcgtctttgtgtgagctgtttctctttaggactggatcactcttgtgtaggtctgggtggccttggaatcacagagatctgtctacctcttaatcctgagtcctaggattaaaggtgtgtgccaccacctcctagattctggctactagtattaaagctgtgtgtcaccgctgcctgatctctatagcttgaggctgactttgcttttctgaattctcagtcaagctttaataaatcatgaataatagatcactacagggtggggcacagattcttccataattcatttctgaagtaaggaataagttgacatttctttagttcttcccttgtgcacactgaagagcaaatacttttgtgtgtggaatctccttttaaatgtcacaaaaaaactttggggatggctgtagggctgcctttttaagtttaataaactaaggcttggagaagcccagggctctctcaggccttgaatcggtgactcagccaacatttggatgataagatccaggttctgtaagattgcactttctgacataatgttagcgagttgctatgctttcacaaattacaaaacccctttgttttgaaaaagtcatattttgtatgtgttctgggaagtttactgttgcttttcatctgacttacacatacctctttgagttatttcagtagaagtcttcaggtgggctggagaggtggctcagcaattcagagcactggctgttcttccaaagggccagggttcaattcccagcaccgacatggccactcacaactgtctgtaactccaagatctgatgccctcacacagacatacatgcaggcaaaacaccaatgcacataaaaaacaaaaattattaaaaaaagaattcagatgaggtgtgatggggagatgttgttacttcctggccttcgctgtctatcattaaggactgtggggtgagccctttactgtggcatggagagcccgctgttctcttggacacttctcaggcactttccatgcacataagaaagaagagggcgtatagatggactgcatatattctcaaggtaaaactgtgtagcttgtggcgtagagaactggttctctaggggattcaaacaagtgagtaatgaagctgacacttatttgctgagttccagatttattgattcgggaagtggagattactttaggtatgttgattaggaggtggtttaaatatgaggaattaagtatttggaaaatctggagtgtggaggctgccattggactgttgacttgaaggtcaaatgatcacagtgttgaatggagacgccacttgtgaggcaaaggctgctttgtggccatgtccgtggctgcatctgccaccatagactccctctgtgaatgtatggggcgtgacagtgaatacgaatctcttaggaaattccatgtctgctggaattttccttttggctcccacaattcctgggagatgccttgtagtttcctcctggcctctaggttgcaagtgagctcatctcactggcttgggctgaattggatttagaatggtcactgcaggggagctggagagactggctgcaggcagagctaagtgaaggaagacaacctgatttttttattttttcttgtcaaactgcagttttatatccttaaaccaatcctttccccattgttaaaagacccacattgaagcctaataggcacaattctgctctctgttcccataagttcatcatttctaggttacacataaaattgaaattgtgtgacatttgtcttccagtgaaaacagcctgatttaatacccagagcacagatgataatacagagacgatcagtaggggtgtgagagggttggaaccagataccccaagatctactgctcagcatatgtgcaactcagagtaacttgcttacattttccaagatttatttttatcatctacaacatggacagtgcagtatactgtaaggagtcagtgagccagtccttggtgatgatgatgatgatgatggtgtgtgtgtgtgtgtgtgtgtgtgtgtgtgtgtgtgtgtgtgtgtgtgtgtgctggttaggggttttttcctgtcacttgaatacaatcgtgggtcatctgggaattgggaccctcacctgaaaaaacaccaccagttagcatgacttcagtggacaatcaatcattagcatggcctcagtggacagtcagttaacattgcctcattggtcttgaacaactgacaatatgaatagtaagttgacattagataccagaaaaagcaagcagtaagacccttccttccttccttccttccttccttccttccttccttccttccttcctttctttctttctttctttctttctttctttctgtgtgtatgtcatggatatataagtgcttttacaggcctcttagaactggagttacaggctgttatgaactatgaactgcccaatgtggaccctgggaactgaacttgggtcctctgcaagagcagcaaattttcttaaccatcgagccatctttcaagcctgtgcaaccttaatttattgcttcaggcttgtcatcatggaccagtgggcttaattctgaggctgcccctgaccatatcctagcagcagcattctggtgtcaaatccgtgaccaccacctagaatgaaagggtctttctgagtctcctgtttagggacgagagagcctgtcccaggagtccttctagtaccttctctgaatcctggacacattttaccattaaacctgtgggctaagacatctgtgccaattagtgtttattgtcaactcgacacaagctagagtcatccaggaagaaggaaccttaactgagggattgcctccatcagactgacctgtggacatgtttgtgggaaattgtcttgcctattcattgacggagaagagcacagtgcactgtgggtaacaccatttctgggcagggcaggtggtcctgggttatattaggaagccagctaagcatatacctgtggagggagccaacaaggggcgttctttcatggtttctgtttcaagttccctcagggatgacctggagtgtatgctgaataaatcctttgccctttaagttaaatgtggtcagtgtttaatcacaccagtaagagccagacttggaacggtgcgtatcttaagagacagaacactactggtaataagcccctgtgccttagactactcccacgagttttttagcttccttgtttaatggtcttctcctatgtggttgcatttctgaaacacaagaaatgcatgggagatagctcgggctgttttggatctgctgtctccaatccttgttgagtgcagcaacagttcatctgtatgcgatagtctgcattggtgccttgtcacacatggctttttaatcagctggtggcggacttctgggctctttgcagtgctgatgtctgaaggaaatgcgctatcagaagcggcgctatgttggtctttggattccaccagtggacttagaggtttgttttagattcatcgtcttatttcttccagtttagataaagctgagttctgttgaggcaggtaacgagttcctgtttgttcatgtgtacctgacaatgatgctggactggggaggtggctaagtggttagcgcacttgctgcccaaatgtgagaggcaggtgtttggatgtctataacctatgtaaaagctgcagggcatggcaggtggcccataattccggcatcaaaagacagaaatgtcgagtctctagagcaagctggctagccaggctggacacatagacaagctgtggtttggactgacaaaccctgcctcagtgaaaaggtcagacagagagcaatggagatgattccagacaacaccccggccccctcgtgtaactccttgtcctctgcccccatggcggccgtgaggaggtttgctgcgtgttgaaacagttggatcttaattttgaaactccagttaagtatatgttaaaccttgttagtgtgcctgttggtaacatgtcaatataaatatgtatctgttaattttagtttcatctttctcaagtctgttatcttgcagtaaacactgaatcatttattggaattcatgcatatatgttttcacccacaacttatttaaagtttaccataccaaatgaaaatttaacttcagccattgtacgttttcataactgaaaattaacctttttcacatttgtttggtggtttccatcagatgttattgctttttacattttctgattcttgttacttgatattctgtatactgtgaagtaattgggaggtgcttttctaatttttaaaaattttactttttaagatttgtttttatgcacagttatcttttgcctacatgtgtgtctatgtaccacatgcgtgcctggcatctatggcaccagaggaaggcatcagatcccctggacctgtgttacagggcgttgtgagctgccatgtgggtgctgggaactgaacctgggtcctctgcaagtgtgacaagagctcttaaccgctgagccgtctctccaaccctacttggaaatttctaagaatacttatttcattatatttctgctcatttctgattatgaattcttacgtttcctttacagacacattttcagaacagttttggtttagagagaaattgcacgtgactagcagggggcgctcgtacacttcccgccttgctttattgagggctcactgtctctgcagcacatcctacacacggttctgagaaaatgaatactgtcacccacaacagcacccgtagagtagatccacggcccggacagccccgcacttcacccatccacctcgcgtctcggaggccccggagactctgaggtttcacgttttgcagaatgcagtgtggttgggtcacatgacaacaggcttctttgacttaatgtgtttgtaacgttttctcacatcccatgtagacagactacgcttgtctctgtgatactttgcgtgtgggtgttctactgtttctgagtacatgtccagctaaggatgcctttttggttgtgagatattacagctccttgcttgcagattctgagcttgcgtgtttttatatccagtagacagaagtagatttgaagtagaaagaagaaagttctttccttcctcgggcaattgtagttctccagactgttgccagggggcgctgtcagtctgagcccacagacatcctcagctgctaacctgtctcaagtcaggcatcttgggtttagagcccagaaagttgacactttctcagagcctgggtcctgggctgcagagctaacagtggcctttgccttctggatggtccgttcacagcctgtagattggagccctctggcaatggctcttgcttaggtgatggaaggggcaggagttgtcccagagactggaaatgttgtaaattacgtttatatccagaacctagcttctttgtaggaaggcatgttctcgcagaagttggggcctttagtagggttgttctattgttattacaaaggtgcattctaagtgcaattcctctgaggcctgaatgtaatctacagaagttctgttttgtaacctcattaaatacggactttgggggtctctttatgaatgggaattctagtcccagatcttggagtgggtttttctttctgtacaggagcctaagggggcacccctgagactgtggccagagcaaaagccacgctgcgtgggtgccccttgtccttctgtggctgtttcgctgactcactactgcggtggttccctttgatgtttgtggttctgtggcttctggccagaattttcatctttcttggcagccaggcttgccccagcctcctcccccctccctgtcctgccctccatattaacacttagactctaggacagtcgccagcatgggcgtcagccccgaggggcatcagtgactccaggacttcttaccgctcctaaatttttataaactttcatggtttctatcttcctaccaaaaagaggcatcttaaatattttatctggatgctgtctggaaggggctgctcacattctgtctgacagttgtgagcaatggtcagctcttctgtgttttcatctgtaggtactggtgttggctatgggccatgtggaccacagctgagccccacccctgcccttgagtagagtgtttgtgtttccctggagtagagtcttcctctcagactctctgcccagtgtgctatgggtccctttatccacatgtaacccccttagctggcacacagaggaatttctcatttccattcctaaaatatgaggtctggaatccatctgatactccagatatggcccttgctctgcagaaacggcacctataaaacagtgtgagaaagtccacacacatagcacaggcttgctttgtattcaagaataatgacaacaggactaagtgattcatgttagaaatggctgggaattgggagagttccaaggaaggagaaagcagattccagaaggcttcagaagaatccagacaccccagaaggactaggactaatgcgagaagcactaggagccttttgcacatgaccaggtgtgagcctatgaatgcacagggggaagaggtgatggaaacataggcaaatgggtggacgcagaagcctgaagcacccatgtaaaatgaagtaatttcaggagaagaaagaaagcatgtgagaagcgacagtgctaactcttacacagatgaggccggatggtggcggcacacacctttaatcccagcattcagtaggcagaggcaggcggatctgtgtgagttcgagaccagcctggtctacaagagggagttccaggacagcctccaaagctacagagaaaccctgtcttggaaaacaaaacaaaacaaaacaaaacaaaaaacctcctacacagattaataatctacattgtgagtgaaccagcgtccaaggacgctggtaacatacggatgaaatccatcctggtgtcagtgggaatagcccatagcaggcagcgtgcactctagcaggcggtaatagccagtagcagtcagcatgcactccagcaggcggtgggcataacagtcctttgtgtctctgagtgtcacagaggctgtaaacaaggcctttggtattctggacaaatcagagccatcgggctctcagctgcctaagtgttaagaggcaatagagtgactgctagggtttgtttatttaataaaaaagtcttcaatagccgaaagtttcaattttttatttgtttattttataagtgatactattaaaaatatttacactcctacttttaagcccacttttaagtttagatttcttatcataatctgacagcacaggttctttaagggctgggggaaaacatttcattttaaaaaaaacgaatattggcaaataaatgtttttctctgcgatttatattgaatatattaaatctaaaaagatgcttatgttatttttttcaacctgataaaatgctcgtgcagcctctcatcaaagtaaagcttagcagtgatgaaagtgaacttaattacaaatggcccttcatctgccattcagtgagagatttcaacagaatttaaacaaacaagaattggtaagcatcgctgtaggcaaactgtgaaatacctatctttgtgtccttgggaacttcaaattaccccattgctggaactgatctctaacgatcacagagaaggggacaggttccacacctagtgtctgtcagccatgttcccgagtaccccagcattgcccttatcctctcccaaatgtgtcttctggggcgtgggctctgctggcatccaaaggcttacaggctgggggacagcctgcggcagcatcaacaaatcactaactcatcaccttcaaatatgtgttttctaaatttagaagggagattaagtcaggaaagtgtctctgtgggttaagtcaggattgcccttcctgctctcacctctttatttagtctgtgaagcaggtcacctgggcgtctctgtgttccacagagaaaacccataagggttatttccttgttaattatccccaccatgactttgtttctctgttttttaactatttctttctatgctcctgtgtagtttccagcatttccttttactttaaaacattgtgtgtgtgtgtgagtatgtgtatgagtgtgtgtatgtgtgtgtgagtctgtatctgagaatatgtataagtgtgtgtatatgtgtgtgtatgtgtgtgagtgtgtatatatgtgtgagtctgtatatgagaatgtgtgtgagtatgtgtatgagtgtgtatgtgtgtgtgtatgtgtatgagtgtgtgtgtgtgtgtgagtgtgtatatgtgtgtaagtctgtatatgagaatgtgtgtatgtgtatgtgtgtgtgtgtgtatgtgtatgagtgtgtgtgtgtgtgtgtgtgtgtttgtgtgtgtgtatgtgtgtgtatgtgtgtgtatgctgtctctgcctcctcagtgctgggattacaggcatgctgttgtgcctggcttccagttttttggtaagagaattacttactcactcaatgactttagggctgatattaagcacccattttgttttgtgactaggggaaatatttccttttttcaggtttcctagttaggtctttttaatactcacccagtgtacatctctgtctgttcctttgctctgaatcttttgttgttcttttggtggacgtgtggttcagggaatggaatgaactggacagtatcctcaagggcaaaagtctggttgtctagaagaggggctggcattgtttgggtgtctgtcctgctctttcccaagcttcttcagggacagttgttgacatctttatggtgcggtctgggcattttcatggaggcactccattgtcgatgtgtcctttaaaaagttccagtggggatggagagagcagttccttggaaaccagacccacggagcacatctgtgttgcctctagaggaagggctcaccttctcttgctcatgcttggcttacagtccctcttcctccgagagccacccttatgtgagtcagggatgctttgggctcatcctgaccaccgcagagtgttatccttcagctctgtgaaggctttaacgtgtggatgttttacagtgtaggagagaggcaggtctgacggtatagtacagtgtgctttcgaggcacaagcggactggagtcaggctccaatgtgttgatctgcattatggtgggctttgtgctgtttctaaaatttctagaacagaaaggtttccttgggggactgtcttgtttcaggaggcctgttttgtttaactttttgagcagatgtgtcattattctttattagaaagccctcttttatgctctaatcttgtaaagtacagagatctcggagctagcattggataactatctaataatgaccttctgagtaattgatgatgtcatagctcctccccaggctggagacacgacttaggcctatctgaggtgtccgctggatggttttacaagctgctgattgatttgaaaccctaagaccatttagttgacactgagctgatctggctgctttggccagagtttgggtttagatgaatttggagtctctaccctgccaactgtcaacctctggagcccatccgggaaccacgtaggaggtgtagactatgaagaactgtctgagggtgaactgactataaatgggagaagataatcttaagacagttgagcacacaagctccagagactgagaggatccctcctaaggttacgaccctccctatcttgagctcagagacccagcccctcagttgtctgtgctgttgcctcatgagctttgaaggtgattttgtagttcacatgagcagatgaaacattagtgaaattactggatgtcttagttaggtgtttatttctatgaagagacagcatgaccacagcaactcttataaagaaaacatttaactggggaggctcgcttacagtttcagaggttcagtccattttatcatcatgacggagaacacggtggcgtgcaggcagggatggtgctggagctgagagtgctacattttgtagacaacaggaggtcgactgacagacacactgagggaagtttgagcaaaagaggccttaaagtctgccccaacagtgacatacttcctccaacaaggccacacctcctactagtgccaatccctttgggggccattttcgttcaaaacatcacatgagggatgtctacacagcattcagctttaataatgacacaggaggccctagaacagccttgaagaaagccaaagccacacgacttcatattattacttcttatcatttgttttctgtggagatgtatttgccctcttagaaaggtgtgtgtgtgtgtgtgtgtgtgtgtgtgtgtgtgtgtgtgtgtgtgtgtgtgcgctcgcgcacgtgtgtgtgtgtgtatgcttttttttcacatgcttgcatgtgtatacggtttttaatttgagttaacagggtattgataaatgtcccttatggcaaaaggtttatgacaaacttcctgcaggtgattgatgtatgttctagttgatggctttcatccagcatggaagcccagaagcaataagagtctacaaacccagcagttgtcttgtgtgttttgtcttgggcgaaatctcagaaccgtgtaaggacagaattttcagcttgagtttgcagggctagagacaaaggtctgggctcaaacaaagagagacacaaacaggacttgtcagtaagggaggaacagacagtaaatccgacttctctgcttgtttaccaggtatttaaggtccctcttatgttgattttcccaagattccaaggaatctagagcagtgattctcaacctgtggtctgcagcccctttggggccaaatgaccctttcacaggggtcgcctaaaaccactggaaaaacacagatatttacactacaattcacaacagtagcaaaactgtagttaataagtggcaacaaaatattttatggtttggtgtcaccatcacacgaagaactgtattaaagggtcgcagctttaggaaggttgagaaccactggtctagaaggttgacgaatccagctgccgtttcctggaaacagggtggctctttagtctgatacaggaaatgtggtgacctggtgcagtgtgcagctgcttaaactggctgtggggcactcccaccactcggggtgagtcaaggagatcagttcacggtcatctttgtctaattaggaggtttgggccaacctgggatacacgaaatcctgtgtaaaacaaacagaagactatcaatcaaacatattccttgtatttcctgaagcccaaggaaaaggaaggtgtccagggcacaccttttgttacttcgtcagagggatggagagacaaggaaatgtggggaaggaatttgggtctgggtttagaacccagaagcaagctatctgcccgctgtgcggcacacagcctcatgagtctattgtggatcctggaccaagccctcaagtagccttacacatctttgagggaagcaggaattcctcaagattccacaatgggccacagtgatgttacttgcaaggccaggtgtatttatctgcagattttactcattctgtaatctgccagacattgtcctaggtagctggcattgcccttaacgatggagacaaagtgtctcatggcccacaggagttatctttcagttatctgaaatgtgtgtgcaggggtggtggtgaggggacattaattctgagtgtcaactaaactgaaattggattgactgacaaaacctgaaagatgggccattactgttcccccatatggcctgtaggagtgtggggcgggaaatggacatttgccgtcagaattagggataagactggctggtcagtggtgttcctcattgtgtggctccttcaagaggaggctttggacacggcggtgagcgggaggcgtggcctgctgggccaatctgtggagggtcagctcctgaaagtggtgggatggaacgaggagaaggtttccaatagatggtcttagttctcagctgtgggtgcctcatggctctacgtgttaggatctggaaagttctgtttttaaaagccagaagcaaaaaaataaaaataaaaaaaaataaataaaaaagctggaagcctcctgcttagattttagatgctggattactaatgccagtgcattctctctgtcttcctccctccctctccccgcctgtcgagtgcacacacacacacacacacacacacacgcacgcacgcacgcacgcacgcacgcacgcacgcactcacgcacgcgcgcacacacacacactcttttttaaggaaaagagaaaaagaactgtgatgaactgttttgagcagcactctctcttccgggaagactgttcctgctctgtttctgagctcctggcttatagtctgaatatgtagtgtgtgattgcagtccctttaaccctgtgagatcagctagctttgaatgctcacctagaagaaataagtttaggtcgtgtagttgacggtaccatattagtcctttgtgacagttgtcaaaatgtcatttggatttgtgctgtaagcatggcgccgccccccaacctgcccaggcctactcagctctggggttttacgtaactaattctcctacactgtagttttccagtattttgtcattagaataagttcagggctttgtggatttgatcactgacctgggtttaatgttgtgtaggatataatgaacaccatcaatttctgatcctagggatgtaaaaccttgaaacatctttttaaagcctgttaataataataataataataataataataataataataataatacaaactgcccttacacactgcataagtttgcatatttctgaatctttatccctgccttggaattatccagatattctgtgggttgatgtttttgttcagcttgcttacactgacttattttcagaaattaaaaaggattgtttattgaattctccagtgttcccgccttttgttgactcctggcatctttaaattaaagtaattattcttcataatttcttcagagagctgagcatttttttgtctcttcccttgggttgaaccaaagagcataattatcgtaatgccgtggccagtgttactttccttttaatggtgctaggattcaaacccaggaccatgtacgttccaggcaagggctctgccaatgggctatatccccagcccaaggctgctattttaaaagcaagatggctttctcctgaggtcgttgtctgccaggctttgctgcttgtttttgctgttttctttaatgttggcagactccgcgtgaggagctctgctagccttgagacttgctctcaggttaagatcttgatattggttcatcagagctgttcttcctggtgaaatggccttatgaaaatacgggccccacttctgtgattcgaagagggagtctagtgttttgttttgtttttgttttttgagatagggtaccaagtagcccaggcttgcctcaatctcgtgattttgcactcagattcccctgtttctagtgcgctgagattataggaggcccagtttagaaaaaacaaacaaacaaaaaaaaacatttggttacaattctagaatttgaaacctttgcttctcaccggtgaatcctttttgataggaactggaaattctccggctggagtctagctgagtatcctacggagctggttacctgtgggctgcaccaacctccccaacaaggcagggttagcactagtctcttcttagactcttgtctggccgacagtgtctcacttgtcccccttctgtacctggggtggaggctgtgctgccctcagctccccctcgagccatggtgacagctgacagaccagctcccatccgcctttctaaaccctaaaggcttccagtgtccgtctctcccatcattggtgaccccagttgttctgagtcggagacggatgctggagagggagagggaggttaaatgtggggcacagttgcctctccagtgggagaagtgtctgtgactcaagtctgctggggcaagcagtaactctcaatgacctcaacctgcccacacttttttatacggtgagaggtcgcagagggttgagcctgctcatgtctcggaaacaaagggggcatgaagtagggagaggatttggggagatggtgttcccgaaacccatgactccaaaggccagttctcggaggcacagacacaagagagccttctgggtagtgatgatactggggtggtgtttacaggggttttcatgcttggcaatggcagacgagtttcagaccaggagagcagggacagtatttaccaggaaggacctgaagaagaaacgccaagctgatgacaggtgccagcttcagatggaccgcacccttctgtggctcagagcccttcgctggcttcctttgactaacagggaaagcatttgctttaactcctcaagttgagttaattttttaattgctcctgagcttgggacaaacaaaacacaatgtcaattttcctcatgcacctctgttgctttttcctgagcttagatggcagcccccactaaacaagggagccccacactaccaacatgcaggaggttagagtgtttttgatgcaacttgaacttgacattgatcccaggtgcggttctgtgcaggctgtaaacagttcttaccactttccgtgcatattccagatgctcttcccgtggtacctctgatttctctggaaactctgccccaccgcctataaggcacccctcatactcagctagctagtgttcatcttgaagacctcagcttaaacttgggctcctctagtcacgctgcctgaggctgaggctgctcttttcctctccttggattgcaagtcttactcggttcacacctctgatttctcatttcagggttcctgaggtggctgcaggatcttttatttctctcagaggagctcacagtaggctagtgtaggcacatagtgagacttacaaacgttttatgggaaaacattgctaataggtactttttatatggcaattccaatagctgatatttaaagtgtgtacatgtcctggatttctttctgaatgtgatgtagcagatagtggttattgaaattacttattttcggtgtctcagaattgtccataagtcttacgagtgcagtaatttgaaatattattttttaatttaatttctattttttctttcttcattttcctgcacacacttgatctgctccaagtttgactcttacggatgtcatggtaaccgggcacagcatcctggggttaagttggccttttcttccctgacatgtatctcaatgccgtgatgtgcttgctcctttgttcatcatttccttacatcttgtctttggtgatagaattatgactggtgtgcccttgattttaactgtttcccctcctgaaaatataaacccatggtatgtctgcagcacacatagatttgtaaactagcaatatgtccaacagccctttatttttaattttcactaattaatgctcagcaatgctactcatctatttatcgtgtaacttggtttttatgaggttatggtagtgtgcatgtttccctcaagctgagaaaattttgatgcaccaatcaaagctcaaacaacaattttaaataaaaccacttggccatcactaagccacgctgagggttggactttctagaagtctagttgcctttatgtcagccatgcttctgtaaggaaccctaataaactcattggttcgccaaaaaataaaataaaataaaatcactacaaattttatttttattgtaagagtggtaagttattacaaacatataacacatatgttctcttcaggaatccaacctcttgagtccggtgcaggatggcgtgaagacgccgcaaattgacagcaacaaaggcaacaactaccggatcgtcaaggaggtcagcagccggggtgcggtctctctgcgtgtgcacacaggggttgtttttgttcaggtgcatgttacatggctgtgtctaatgcagcacttcatctcgttaaagatcttgatcaggctgagtaagctctgcgtgcagaacaagaagtgtcgcaaccaacaccagcgactgctgaagaacatgggggctcacgcggtggtgctggaccttctgcagatcccctacgaaaaggtttgccctgtcccgccttccttcagatctgtgttactgaaaatgtatcaacaagtttaaagaatttttctctccttaattgtttaagaggacaacccctaccccagtgtccttggattcttttctgtgtttcccacacacaagggtgtgcttttgtgaaacctgcttccaccttgtaaattaggaagaagcacgatacaccatcacctaatccaacacagcgcgcaggtttcttccatagttccagccatgtccggttgagaaaagcatctgctttaggagcacgctaactccgggcttggttgttctgtctgctctctctcagtcctgatctctcttgtagactgacagttattctggagagcgtccctcacttcctcctttgctcaggttccatttatcttcggtgggaacatggaaggattctagtttctgtgccgagcttcctagcaggcacatgaggctctgatttgttcccacacgagtgatggatgcgtctgctggtttgtccactgtaaggacctccctctccctttgtaataactaactattctttcctgaggttccattgagaataccccgtccttcatccagcctttaattcacattttttgctagcatgggcatgggtgggtaattggaaagtctggaggaaagatggagagggtgggaggaacggagcagacaggcaggaagaataaagagaaggagagaacggtctagaaaggaagggacagagccacagagggcgtggagaaaggagagcatgaacagagccaggaggcggcatgcttggtggagggaggtggttttgtgtaagcctgtcctccgttctcggtgtcacgtgctgccctttcgcctgcagaacgatgagaagatgaacgaggtgatggaattagcccacgccttcctgcagaacttctgccgggggaacccacagaatcaagttctccttcacaaacatctcaacctgttcctgactcctggagtaagtaccgtggcggcccctaacacttacggcaggcagagcgcgtacagcatttactgctctgtgaaaaactttgttgacctttgcacatcgttcttccctggagattcactccataaacttgagtgtttccgtagaagaaactcttaattagaaaatttagacaaatttcatctgcaaacggtggtttcatttacgacatgcgattcaatgttagaataaggattttagaaagcttagtgcttttttcatgataccatgatgaagctaaatatggaagctggggttgtagctcagtaatggacagcttgtctagcgtgttcaggacctagcaccacaaaacccgaaccgaaaacaaactcacaggagctagatgctgaatattccaaggttgcgttgactatgaccagctgaaagcctgggggcagatcttggggctgaagaagagcatttctgtggaaacgtgaggacctgggttcagatccccagtgcccacatagaagccagacacggcctcgtgtgcccgtaatatcggtgtggacggcagagacaggagaactggaggagcctgctggccggtcagtgtaattgggataggtctcaggttcagtgagagactctgcctcaagggaataagaaggacagtgacagaggagtgcgccgatcctgctgtggtctctgcatgtgcatgtccatacatgtacagcacgtgtacctgtgagcacatatacgtgtgcacacagcacacatgcttataccatactctcacaaaaggataaaaaactagcagatctttagagccaagttggaataacgaataagctgccctcaagtcgctgacagtgcacttgctaatttcctctctccagctgagtcccattgtgaggcagatgtctgtctgtccttcagtggttcatgactcatggtgtctcacccaggacaggcactggccactcatggtggcttcacttaggacaccaggcccatggcagtcagggaacataggccctgtagaaccctggccccgcccagtcacgcaggtgcgccctctctgctcagctcctggaagcagaaaccatgcgacacatcttcatgaacaactatcacctgtgcaacgagatcagcgagagggtcgtccagcactttgtgcactgtattgagacgcacggccgccacgtggagtacctgcggttcctgcagacgatcgtgaaagcagatggcaaatacgtgaagaaatgccaggacatggtaatgaccgaggtaggtttgtgcctggacccgcgtcgccagcttgtagcgggaaagacctccggagccatctgggtttactgtgactgctgaggcacccacaggtttacactggtgcagtgcagtgactcagggccatctgacctcacggtcttattaagagtttttctttttgatctgtaacggaattggatccgttacataatgggtcatttttaaatttgaaaaatcgtgtgtgtgtgtgtgtgtgtgtgtgtgtgtgtgtgtgtgtctgtgtgcgtgcgtgtgtgtgtgtgtgtgtgtgtgtgtgtgtatgcctacacatgtaggcaatcatagctattaatttcctatttaagttttcttgtatcccatatattttgagatattatcttttattttcttttgtttctgggaattattttattagttgcatcaatgacaaattcatcatttaatagtatgtcatacaatatctattaagtttcatcggatatctgttaagtccctttgatcaatggtatcattgaattcagctgttaaattactctttttatttttgtttaaatgacctatcagttagtgagggtgaagtgttgatctcacacaatattcttgtgttgggataattgagtttgtttcatacaattagatgcacatatattcagagaatatgtgtttataattataacataatgataattgattgctcacttaatgagtataaaatgaccttctttattctttcccattaattttatcataagtctgttttgtcggatgtgggaacatcagcacgtgtttgtctcctaggttgatttgctagagaagtattttccattcttcacccgagtttagtagttgtgttttatcaagaggtgtatttcttggaggcaacaaattcatggttcctgatttttatacactttattactctgttaaaaattgtgtgtgtatgcatatgtgtctgtatgtgtgtatgtgtgcatgtctctaatgtgtgcatgtgagcatgtgtgcatgcctttgtgtgcatgcctctatgtgcatgtaagcatgtgtgcatgcctctgtgtgcatgtaagcatgtgtgtgttgtgcatgtctctaatgtgtgcatgtgaggatgtgtgcatgtcttgtgtgcatgcctctgtgtgcatgtaagcatgtgtgcatgtctctgtgtgcatgcctctgtgtgaatgtaatcatgtaagcatgtgtgcatgtctctgtgtgcatgtgtgcatgtcactaatgtgtgcatgtaagcatgtgcatgtatgcatgcgtgcatgtaagcgtgtctgcatgtctctgtgtgcatgtctctgtgtgcatgtaagcatgtgttcatgtctctgtgtgcctgtgtgcatgtctgtttgtgcaccatgtgtatgtatgtgcctgtggagaccagtagagggagttagatcccctggagatggagcaacacctatttataacctgcttgatatgggtgctgggacttgagcctgggttttctgcaagagccacaagtgctcttaaccattgagccacctctccagctcctacaatgggtgaaatcttaggagatcacaaggttatttggaattaacacaatttttctatttaaaaattcctctttctgaatgataggacaggtactctctgccactgtttgtaatagttttgaggaacagcgcatgagttaataagtgattgacagggctctattagagcagtaggaactgggtattttgaatgaggtaagaacttaggaaagtgagctaactgctttggaaaggttgatgtgggttagctgctcactagggacacaaaggtggccctttggagaactggtgactagatgcaggctggtggcctgtgcatcagagcagctccacccacagctgcaaggaagctgttacccgggggatcgcgttggtctggggaaatttccatcgccacatgcctttcagttagaagtgagagatgtctgatgtctctgtgttgatttcatatgtcacccagaaatcttaaaatgcaatgcagcctaagacgataaacttttacaaatgacctgtaaataaacaatgaaaagcgcactgtgaagcaaatacgtaggcccttcctttggcacctatcaaaggaaatgcttctgtgtataaggaaatcgttgtaatattatgcataagcatatttggatacataaattcctttgcaacaggactgtcaaagtcagccaatcagttaattggctcattgatttaaatgttaccaatttaaatatagtaactaaattgaaatttacatatcatccataacctgaccaaatatttcctatcaggcttagaaaattggtgtcagtaatagataatagcatggtaaataaaatttgctgccatcttgagcgctaaaagcatacaacaaaatatgaggagcattcattcatgtcccaagtgtaccactcaacattcatgtccaagtgtaccccgcttgtcatctcagctgttctactctccgatgccctcccataaaatgaggacatttccaggtattcatacagttgtaagtacttgaagcaatgtgtaagtttgcttacttactaatgcgaatgcttttctatgattcatttcatttttaatgtgtatagaagtgtgtcagtctgtgggtttgtgcacgtgagtgcactgcctgaagaggccagaagagggcgtcagatcctctggtcctctgcaggagcaggggcttctctgtctttccagtccttcactttactactttatagaaaacagactcaggaactcagacgttcgcttccctagtgctggggttacaggtctgcacccccaggactggctcagtgctgtttggttcttatcccatctgctggtctcatatccccggcccagttttggcagcatcagtcaccagtcacttggcatttgacctttctctcctcctacccgaggaagctctgcttttgcagtgtgtgtgtgtgtgtgtgtgtgtgtgtgtgtgtgtgtgtgtgtgtgtgcgcgtgcttgtttgtgtttgtatgtgtgtgtgtgtgtgtgtgtgtgtgtgtccgcgtgcttgtttctgtttgtaaacagatctgtgtgtcgtcaggtaggtcgaaactcttagaaatgtcgaaatctgctatgcggcctcttttcttcacttcagttgatcaacgggggtgaagatgtgctgatattttacaacgacagagcatcatttcccatcctcctcaacatgatgtgctcagagagagcccgcggggatgagagcggccccctagcctaccacatcacccttgtggagttgctggcagcctgtacggaggggaagaacgtctacaccgaaatcaagtgcaattctctcttgcctctggacgacatcgtgagggtggtgacccatgacgactgtatccctgaggtcagcccgacaaacgcttatcacgtgtagaatgctcctgtctttaaagctcacctgggtgttgggcgtctcccatggtaatagttatgatgacaccacatatttagtagagggattattggtcatgtaattttcaaagtggaaaagagcacaaagactttgagctttgtttgcacagaaggaagacaggccccttgactaacaactacaaatgtctcgtaaggtagtgggttttcagggaaaggttcacttgtagttttgagtgtgaacccggtagctcattggtgagtcagtcattggtgagagagcctaggccggtgctgcagggacccaccatagatccatggctttacctggctgcacagagtatgagtcttctcgagagcatgccacaccctctctcagcctctcttctacctcagctttgacaactggggaaaaatacctggcagagagtgattatcggctgaggaaacccggattgtcagtgaggcttccaggaacacacagtgtaatgatttctttcttttccgctgttatggtatgtcacgacaagttcataaatatgtgctatacactaaaggacataaaatcaaaaggggtcagggaaggtctcagtccctattccggtcaccttgggccatgacaacacagtcaagaacctgaaggagtatttatgtggaaccattagcatctcagtcccagggtccttcctgctttggtggggctgagatggcacagcagagaagggtggagtggaggagaggaccgtgggctcagtctttatccgaggtcctggtctttccatgccagaccccgtgttcagttcctgcttggggtcccgcctttcctgtgttcatttcatgctttacttcttcagagaagagtcctctggctatgcagatacggccacccacatctccaatggagaactggccagttgactttcattaaacctcatgccttcctccaagagggtcggctctaggagggtaatggccatgtatggttcacaattatcatttgggtacctcagtcagagcagatgccagcaaatgtgtctccagcaacttcaacagtgagtcagggtttttatccaatgttctttaactgtgttgttgactcccacagtcaccaacacttccagcatccacagttttaaagtaaaacagtcactgcatctgcttaataggattgagagagattttgttcaattagaggagacatggggacggcccaagggcttcatgcctggtggacaatgagtaggtgcagctgctttggagatgatggtgtctcagctcatcctagcccatggccagtctcaacacggcacacgccattgaggattgttttctagacgccagtggagccgcaggaagcccggtaggcaggaaagctcgtcctttttcctcatggctctgtctcagagtcccggaatcccatggaatgactgacatgatttgtttctatgtacagccttctctcggagacatttgagctcttcctagtgtctcaaggacgctaggtttgctctgagttaagctcttgttttcacagcagtctctgggtgtgggggaatggaatgatggaccacaggcttccctggaccagggtggaatagctgttaaagggaagagagcagggagcctgcacatgtccaaaacaaaccgtgatctgctacaggagcccgcaagacggcatttcatgttgtagaatggaaggcggtgggtgaaaaattgaacttgcttttgcgtttgaaactcacacaggtgaagattgcatatgtgaacttcgtcaatcactgttatgttgacacggaagtggagatgaaagaaatctatacaagtaaccacatttggaagttatttgaaaacttcttggtggatatggcaagggtaagttaaacgctcttcgtggggtaagatcatcggtattgattggtactgattttgattaagcagtaaatgtctagatgaaaaatttgcagttaaaccaactacatttcgatctagtctgttttatccatgaagttgtgaatgagctccaggagatcgcgagcgacattgttactgtaaacagaacacctaacttggcgtgggccgtgacaggtgacagtttacatttataaatgacagcatttgtctgttactaaagggaattgtaggagccttgctacatgggttggaggagacatttggcagaggccattttctagttaaccttttgccgagaaggcaattaaagccacagatggaggaggcctcaagtggttcagggaggaccgtgagcagacttctcatgatccctgttacagtcttccctggctctgataatttggtcatctggacttttcatgaatgttccctagatcacattctgcctttactttgagtctgtttccttttttttttaaaattgggaggtggcatgtggcaataggtatcattttatagatacgtctgccttgagtgttttctctgggaaaatgtgtaagcaacaaggaagggatgctgtttactcttttgtgctgtctcttttgcataacaaatcattattagcaccaggggctttatatatatattttttcaaacaaggcttcattccatagtgcaggtgggcctggagtaactccaggcgagcctcaaactcacagctatcatcctgcctcagccccataagtattgggaatacaggtgtgagccaccataccaggctctctcatttgagttttaagagcgacaagatgtgaagtttgaataaggatttttctaggaaaggcagaatatccacagctccttagacctggtacaaattaaggtgacctgcgcagtcccttaggccgtcctgccccctgcagccctagtagcttatgcaggcctaaacttgttagaggctggggattcccagaatcttacaagtacgattgctaccgtatctggtagttggtggcctcccttgcactctttctggaggaggggagatgaaatccatacgctagagctcccaccgtaaacccgggcagccaagaacaaccctggacgaaaaggtggatcatgtgttcttcctagttagtcaagcatttccagaggaaatgtgttcgttttatttttggtgtggtagagtgatcttcactaggttcaagtacaggcatagttagtcccttcccgttttacatcatctttgtgtgaccagcaagaagtcacttcgtccttcctttctgggctaaatcacagctaggtcttccacacttagctcacaccattaccgttgctgttgccactgacatgaggaaagtgcagctctcaccagctgtgggcagctcccgaggagtccttgaagcgaagggtaaattcaggggctccactggtgcaggaggatgttaaagaccttccaggtggatgggcatgaatcttcggagttccctggtgcctgtgactgagataagctggagagagagagagcaaggtcacactctcagaagttgtcagctgtcacgctaacatggagctaattttcttaaaactaaagagagctagtggtggctgcctgacccagctactcctgcacccacgcaatctttccacttaggaattcagagactgtgcaccttttgttttcctgagtttgcttaagtggctgattatgaagtattgcttattacatgaaggctccactctgggaggcttcctggaattcctgcctgtctgctcaggttgactgctgacgcctttgttcacctcagcttctttttttgtccttcaaagcagagcttctccagggtagacatgaaaccacctggcattttccagaagaggaaacccagggcacagggtcccttcctctctcttcaggaagtttccacattctagtaacaaaacaacccaggtggccttctgcgcagctttccatacagatggctgagccccgctccccagggtctcagactcggcacttgggagataagacgtttgaaacaagtcttatgtggcaccacggttggtcctggggtgacccaagagccactgcagtgggatctggaagggatgtcaaaggaatcagtcagactggggttcagatccaaactctgtctttccctgactgccttacatatactgggaaaggcactgtaaccctggttgccttacaataaatacattttcccaggggccctgggaagagccggtgaggtaacacacaataaattcttagcgcatcctgctctttgcaaaagccttggtggcattatgtcattaccaggattatcacaaggctgtgagaagccttttgggcagtttcaggagcttctccgagtcctaagtgatattgatgacataatgacattgagagaggcaaaaacagactgttcatacaggcgagagccagaccttgtgttcatgcaaccagacaaacattacttgggcttgcatgatgctaaacatgcatgaagccaggcgtgcatatagccagacctgacagatactatgcatgaagctgggcatgaattaagctggaagctgaaaaatgcatgaagccaggtatgcatgtatcaaggcatgcatgaagccaagcatgtatgaagccaggcatgcagggtagtagaatgtgaatgaagccagctacacatgagatcggacgtgaattaagctggaagctgaaattgcatgaaatcaggtatctcagagtttctattgctgcgaagagatgacatgccacagcaactcttttttttaaatattattattattttagaggcactcatatttacatatccatccccccattccctcgccctcccatccaatgttccccaccaacacccaacccaccccccacctcctccccagagatagtgaggtcctccacaggggaccttcaagtctgtcatatcattcggggagggcctagaccctccttcctgtatctgggctgcaatagtatccctccatagggaatgggcttccaacgcccatttgtgctctagggataaacactggctccactgttggaggtcccatagacttggcctcctagctggcacccacattcagagggcttggtttggtccaatgctgtttccccggctttacgactagggtctgcatgctctcactaggtcaggtcagctgtttctgtgggtttctccagccctgtcttggctcctttgctcatcttcctccctctctgcaactggattccaggagtatggttcagtgcttagctgtgggtgcctgcttctgtttcgatcaactattggatgaatgttctaggaatgttaaccaaggtagacatcaatttcatcataggggaagggcatcaaaggcagcctcttcaccactgcctaaattcttagttggggtcatccctgtggatcccctaacatttcccctgtgccagacctctcttcaaacctgtactgtctccctctatcaaggcatctcccttcttgccctcctctattcctcccccatctcagtcctcttgttctcctcccccaccccttctccctttcccacctcctttctctcccccctcctgtgctcccaatttgcttaagggttcttgtccccctccccttcttcaagggactatgcaatcttctcgtggggtcctccttgtttcctagctcctcaggcagtgtggattgtaggctggtgatccttagctctatgtctaaaaatcatatatgaggtggagggaggaggccacagcaactcttatacaggaaaacatttaattgggggcagcttacagttcagaaagtcagtccattatcatcgtggcagagagcatggaccacttaggcagacatggtgctggagaaggagccacgagttcttcatccagatcagtaggcagcaggaagagaaagtgacactgggcctggttgagcatctgaaacctcaaagcccacccctcagtgacacacttcctccaacaaggctgcaccaaccccatcaaggccacacctcctaacagtaccattccctacgaccaatggaggcctcattcaaaccaccacaccaggtgtgcaagaagccaggcatgcatggattcaggtctgtgtgaagccgtgtgcagacatcacttgatacaaactgctgtcaaggaaaagcatcagactcaggtgtgaacagcaaactcctaaaaccccggagccattgattgccatcagagagaaggagctggtgaagagttggtgctggaagctgggttgagggcacccaacatggcaggggtgaaagaggagagctcatggctggtgtccagtcttagttttcagcatctatttctaaaatgatgccattcctatgtttagcatgctttggtttttatttctacacaacttaaaatgtaaagattctcacactgactccaagttttctttattatagcttttaccctgattttacctgagcagcaacatggggcagtccagtcaagcaaaggtgtaacatataccacgagtcaccagtcctccttgccaggcctactttgaaactataaagctgtgaaacttagaaaacttctaggtggcctcataattttgctcctggagtccagatgcataattttcagctgacaccctgccccctgcttgttatagcccagaaaggaaggcttccatcccaacccccagctccagcagcttctcaaagttagccttcgtgtctgccagtgttttgcccatgccctatactggtcctcttttgggctgtgtccaatgttctgtttccatatctttggattctccgtagcctgcctgagcctgcacaattgtatttcggtagaaactcggagaagagtttatctaaaaagacaaatgaagtctcaaagctagcagccatgcggcatctgcttccttcccacacttttctgtagtcatcactaccaggtcttggggttctcagaaagccgtctggagtcactactgtttgtgtcttccattttcctcttcatggcctttatccctcataaggggcaagcacccacaggagtggtccagtgggtaaaggagagggcttcagtgggtaaaggagcttgctgccaagtttgagcctgggaacacatgtggtagaaggagactccggcaaagctgtttaataaatgtaaaaatgatttttgaaagacacacagaaaatctttcctgaaaaatagcttttaataagctcgctgtgttatattgtctcatgtggtcatccttctgatgtcccgacagagacggggcccacgagctgtaaaacagcacaccggggcagtgaccaagtcattagacccagaagaagttgttgcttcctttcagaccgttaatggcggcccactttgatctatgttctaatgcagctgaaacctgtgcgtgtggggcagaaatggttttcttcgtcttggtaactgcttgttgttgcagtcaggggactcgggccattatcaggaggccacctagaaggggtgggtgatgattggtgttagtctcagactgtaggtgtaattttttgaagatgtttccgccttggctatccctttggagaccttacggccaccagctgtattctgagtaatgttccgacagaacaaaattagaccaagaaataatataggatgtgtgtccactgagtgtcatatcagtcatcgattaacaagacagaccaggataccgtgttttcagtagattgcttgggccattcgctccctttcctgccaagcagaagtttggagatggggagaatatgtgtctgccataaaactgcttctgcgtggtctttgttagacaggactaagcagatgtgctatgattttgttgatttttttgtttgtttgtttttggtttttcgagacagggtttctctgtgtagctttggagcctatcctggcactcgctctgtagaccaggctggcctcgaactcacagagatctgcctgcctctgcctcccaagtgttgggattaaaggtgtgggtcaccaaccaatgtccggcaattttgtaaaaagttgaatggacattaataagattcacttgaaagtgttctttttatgtggcccaagaagctatcgtggcagggactggagacgtgtcttctgtagattttgccctctctgtggcacctttcgctcagcggtaactttgcagacccagttttatgttgtttctcgtccttccccgaatgctttgtgcttcatgtggtcggcagtatccattctagtccatcagttctaaccccctcccccaagtgtgcatctgttcatgtgtgcaggggtgtgtgtaatggctgtgtggagggtagaggtcaacctggggtgtcattcttcagaggttctatccatcttagttttagggacagggtttctcactgagtctatcaccagccagtgaacaagcacctccctgtttctgcctccagcactggtttcatgtgtgtgccaccataccaagctgatttttttctcatttttaagatgtattctgaggcttgaacttagtaaggcaagcttgtaaggtaagcactttactgatcgagctccttaaatcctttatctgtgttcctggagtcacctgtctgtctgtctgtctgtctgtctgtctgtctgtctgtctgtctgtcgatgtgtctttcaccttattggccactcccctgccacttgactgatctctcggtatcttcccacttccagatattgaggtatggcagactcaaaccctggacctggtcccttcactgtctgtaggcacttgcttcctgggatcagcaactctcaaatattgatcccaggttgactgaagcccaagtccttctctgatgtcgagtcttgagtctagatgtttacctgacgtttccatttatctgtgtgccccttctcaagttgtgggcagttccagcgctcccactttgcatccagacagacatcctggcatcatttgcaaatcgtactttgtaccccctgaatctgatccttcaccaaggctgtgggttctaaaatgccattaatttggccagttctgaactcttatgtcatatctgtccacatctggagggagaagaggaggaggagggtgtgtgtgtgtgtgtgtggggggggggttggatcaggtccctgcttccctgagattgtccgagactttccaccttttctgtgccttccttccccatgtcttcctagcctcctgctctccttgcagctggctctctgtcctgttgacagtggtctctgttctgtttctctgggcactttcatgccagcatctctgccttctgagaggcttggcccagaatctgcatgcctgtccttcctctactgtcagatactggtttagttatttttgttttttgtctccatgggcaatatctggcataaagcacttagaagaggatttattttagctcacagctttggaggttcatccattacagttgggagggcttgtggaggaagcagctgtccaccttatgacagataagtcatggaagcagggcaagaaaaaagagaggacaagaaataaccccaggtgacctatgtcctcctgttgggtcctgcttgctactgccaactacaaatagacctttggatggattttttttggatggatattttatattcaaagtttaacatgcctttcatgcccacctcacaacacaagataccctcaatccatccctgagagtttccatggcattaacagttccaatgtcactccagagtccaaactcagagttttctctgaggcccaaggaaggactcttagctgtgagcctgtgtggaatcaatgttgcatacttccacagtgaaatagagcatatacttccattccataaggttgggataggagcagcaaggaaggagcctaccaaagcaagactgagacacagcagggcaagcattgaattctgtagctgtgtatctggttcagggcaagcggtagtgtgctgtggattcccagggtggggaggccccacccatatagctttgccattttagcccatgtgcctgtgacctgctcagcagatgctcctggtattgctaatgtccttgggtgtctagagaggcttaggtttcatcctcagctccacacattgccatttcaggacccgcctgtagagaccctccctttattcccagtgtagcctgccttcccaggctttctttgaaatctgggtggaaggccctcagctctgtaacttttatattcttcatgctcacaaaattggcaccatatgtttgtggtcaggacctgacaccagattgagcaatagctgggggaatgtggattgtgagtacagtggcctcctagtgcctggatgtctgggtgtggtaaaagctttgttgatctgtactgcagggcccgggtatctaggcttagctgtgctgatcagtacggcagggttggggtttggtgggtttgagttgcttatgcataacagaacacatgactgggatggctacatgaaaaatgtccagtcctgtaaacaatgtgtgttagttgacacaaacctagacatatctatatatctagggactcttaattgagcaaatgcctccaggagagcagcctgtaggcgtgtctctggggcattctctgattagtgattgatggaggagggcccagttcaccgtgattggtgtcacctgtggcctggtagtcctgagctgtataagaaagcaggctgagcaagccatggagagaaggccagtaagcagcagcacatccctccatggcctctgcttcagttcctgcctccaggtccctgctttgagttccaccctgacctctgttagtaatggactgtgatctacaatgtgaaataagccctgtcctccccaagttgcttttggtcgtggtctttatcacagagatggaaagcaaaccaaggagcagtgcaagatacatgaaataaagtaattttaggtattattaaattgacagaaataattataacctgcaggtatagtagttaattccagtgagaaacacaagactcattctagaggtgtgggtgggtcaaaaggtgtgagaagggctaggtgagcactcgggaggctaggtgagcactcgggaggctaggtcagatatggctgtgaagcagagacttcctggagcaggtgactcattcactgacatctgggcactgaggttaaaagccccacccactttctgtcttttctctgcttcctgattggtcaaggtgtgtcaagcccaggctgcacaggtctgcccatctgctgtcacctctcatacataaaaaggtcatttgttgtgatgtcattttgagccacttccaacctttgctcttattaaagaggcaataacagtaaattttaagactggataaagaacacactattagttttttttctgttttattttgtttcctggtaagtttttcacggttgtaacaataaaagagtcttcctccatttagtgactaccctcagtaggaccagtgtaggatgtaaagtgaggatgctttcattcaagcttggataggaataggtccccgtggtttgggaaacaggcttttcattacccaggatttgagtacagcctcatctaggtaacttccgttactctactcactggtgttttgccagtgtctagttccaagcagtgcagcacgatgtacagtaagtccagtgtgagattccatcccccactgcatgggcaaaggtcctgcaggctgatggtggagcgcgagcgctggtctgccacctgctcaacaaaagggcagttttagccatgaggaatattcagtgtttggaagaggcagaaagaagtaaaatcctaagtgatgcttgtcctggacaaatcagcttgataggagttctgggaccatgtttgattttaatccccagtgtaatgcacaaatacagccaaacctaaagttaagtagacggaagtaagagtcatatatgggacttacttacctcagagacttcctcagtggtcatctctcatacagagtttctcgtcatgtcgtcacttgtcggaagctcaaaaataagagatggagattccagaaatgttagtgacgtcacagctctgtgtcacctctccacagtcactgcagtggctgtgtctaggtgatcctcgatttactcaatcagagacccaaatagagtggtggtgatggaagctcatgtgtgccaaagatctgtgtggtgcttcttgtaagtgaaaagatgaatggaatgagagagagagagagagagagagagagagagagagagagagagagagagagaagaaagataggagagaagaaaacattcacttacattcactcatattgtaatataattttaaaatttatgttattaatctatttctgggccacatttgtgaattaaattttgtcatatatatatatatacatatatacagatatatatgtatatatatatgataaaaacatttataggatttggtacttgttctgcagtcacgggctatagcccctgtggataggggttggactgctgtgaacatcttcttcatgcagtagctgttgcttgctgggacaatgtcaaaattccataattagacataatttatttcctttaactaaatcatacagttctccccaatggtctgacaatgttagttacatggaaacccttttttgttctgtcaacattatatcagtgtgtgtcatttatggaggaagagatggaaagggagttaggacataaacaaacccttccttccttccacacttaacagcccggttctccaagccagaagggccggaacgcatggtttgagaagagaagttttcccttttatgaatttgtgtgaaaagttgtagagtggcatcagattaaaccacatccacttgttcttttgatgaagcaccttactgaaaagtcaaaaatcacagaaaaatttgtgttgcccaaggacatcaggaaaacatgggtgccatccctggcttctcaccctttgtctgtatttgtttcctttgtctgcctcggtttccagtcttttctcacacccgctgctccccccacctcgtcgttttgcgtccatatttcctgtgttttcaatcataactcttagctttcgcaatttgtcagtctgacatttggaaatacagtttggcgaaagggcccggtttagtcagatgtaacgatcagagcaagggcggcagggtctgtctgccccccagctccagtaccagtcttgccctcagcctgctctgcggaggccgtggttaaaaaagtgtgggaaggagttagatttatttctccatttctaccctgaattagttgcttttcctatttctgtgatcaaacgcctgagaagacacttgggggcggggcttacttcagctcacagtttgaggtacagtctatggaggggacaggaggacagcaggtgacagcagatgggcagacctgtgcagcctgggcttgacacaccttgaccaatcaggaagcagagaaaagacagaaagtgggtggggcttttaacctcagtgcccagatgtcagtgaatgagtcacctgctccaggaagtctctgcttcacagctgcagctgacctgtggctgtgaacacaaaattcataagctttaagtggatagcatggatgtgtagggtaaactttatagatgacggtgtcctggcaacacatggaaatgttgggcatgcctccacgttgttcaaaacagcaccacgtgtttgaacccgtcggcccgtagaggacatcccacatgggaatctcaacgcctcttcacggggcccaggtactacaagggaaaatgtgtgtagacccaggctcaccacgaattcttatcatccattcctttgtactcaggatggctcttaactcttctgcttcctctcagggagtggaaagttttcatcaaaatctagtttgtggaccaagggagaggttggcgtgcaaaaataaagaaaaaagcaagttaacacggcctggaggagtgaaggctgggatgatatcgaggcttggaggggaagctgccacagacagtgggtttggacagaaatccttccatctgaaggagctctgcaagcccagaactctgggaaactcttagaaggttccgctaccaacttataatgcagaggcgtgctttgctttgcttcctctccaggtctgtaataccaccacggacaggaaacacgcagacgtcttcctggagaggtgtgtgacggagtcggtcatgaacatcgtcagcggcttcttcaactcgcccttttcggataacagtgccagcctccaggtagccgcacgcgccgcgccgggaagctgtaacctggctcggatgtcctttctgccactcgggataatcgctgtctcttacatttctccacattgtgcccttctgccctgaccaaactttattttagcggctgttttcacgtgttttatgtgtcttagctttttccattttgcctgttctgagtcactttgaaatttgcgcttgagcaaagaatccagtttacgcatcatttaatcagattgaaagatcacagccccatgtccttccaccgtctctcccactagctgatctcttctccaacattgagagacctcttaaaactaggtcatttcctctttctatacgctacaagatatttcacaactgtatgcagaggccaagtgttgaaataatggctgattgttccgatgggtgggcacccgggccagctgctgcatgttagtaatttatcctaaaggttggcatattatggtttccaagtctttatagatacttaaaagtatttgcacttttatacgttaaatgtccacagataaggagacagccaaacatggtgtatccgtggggtgtcttgttaaaatttgtgtttcaaaaggaaaattaatggctaagaaaagtgattctcagcgtagctcctcagggtcacatgaagcatcatttagttgtgtttgtgtggagaacacaaatgctcagcccggtgtctgtgagttcctacctgcagatcctgccaacccacaatcgacagtatcagaaaatttgtgtggtgaacatgtgcagcttttggtcattagtctctaaataaccttttctttacataacacctacatttcattaagaattgtaagttggcaacacacggttttatttgatgaatttccgaatgtctaaggtttaatgtctcttttggtgtctgttggtgtgagggataacatctggcagacgctgaccttggctttccctccactgaatgtggtagtggacccctgaagggacaggtggacggtagagctcagtggcctgaaggtctagccaaacagggttcaggctcagtgagaaaccctgctcaccaatataaggtggagagtgacagaggaagatagctgaggccagcctctagcctacacacacccacatatacacacatactctctctctctctctctctctctctctctctctctctctctctctctctctctctctctctctcacacacacacacacacacacacacactcacacacaaatatagtgaaaacacaagtgaccaattttctgtagtgcttggcgtgtttcctctcatgctattaacacacaagacagtttgtggagtcaggtgtttatgggtggcattgaagcacacaacactgttggtactttattttttggggtcctgtctgataaggtgtagctctgctccctcctcaggcatggtgtgacttagggatggcggcacagtgacatagggtgaccagtgcccttctgtttcagacacaccagccggtcttcatccagctgctgcagtctgcattcagaatctacaactgtacctggcccagcccagcccagaaggcctcggtggagtcctgcatcagggcgctggctgaagtgggtgagtggggtctgcgctgactcagatacacatttcctggagtaactggggttggggctgagagccgttcaagcagcttcccaatctagacctcacgaagaagtaaagccaggccatttgttgtttgttgtttaagttggaggccgacgttcagcaactggttctcaacatggcagttttgggagaaaagtatattcctgtttccaaatttcaaagtagtgttctacttcaaatatggcttagtaggattttgtaagagtggtttaactggttatcttactttaaattgtggaaccaattaaatttatttaataataaataattaataataaataatatgccaatttattaataagagcctgatgttgttaataactttttgtggcaacaggcgttttagaggttttttttagcattgtaatttgtgtgaaatctgaatcattcaaaggcctgttatacactgaaggcttcgacattatacatgaatggagacaagggatttaaactaaggggaagtgagcctaaaaactctcatagattctccccctgtgcaaagtcatgccttacgtagttttgtattattatataattttgtgcataataggtgtgtgtgtgtgtgtgtgtgtgtgtgtgtgtgtgcgcatgtgcaggcacatgcatgtatggctcacatgttgaggtcagaggtcagcctcaaagctattccttgccttcaacctaacttaggacaaggtttccttgttgctttcccctgcatgctggctcatggattttcctttctctacctcccagtactgctgggatccacctcactgcaggggtgctggcatccacctcactgcaggggtgctggcatccaccccacagcaggggtgcggagttacagatgtgagccactgcacctggctgtatgtggataatggagactcaaattcaggttctcaagcttacaccataagcactgagccatcttcctagccgtgtagattaattatggatgaagtggaggaaagagaagaaatataggcttggatgggtagaaaataatagtgataaaaaggaaactagaaaggcatctggcgattgctggtgatcccatgttttcattgtcatggtcatggtcatggtcttggccactgttaatgtttactgagcatttaccatgaccaaagacaagggcttttacaccttaacctttgataggttctttggttatttatatttcaggattcaggaaacaatgatcttggtcgggagtttagtatatgatttaatagtatgtgctggacagtcaatgattcagctaattatgagcattaaaatatttttagtcttcacctagtctgcaatctggcctaagagattttatagtaacaaaacttaatggtggaaaaaaaaacttaatggtggcagcaattttacagaaatgaaaaatcagatataatctaggagtatcagttggtgactactgcatttaatagtaatgtagtttgcctagggaattgattttaaataagaattctacttataaatacatggaataagtaattataaataaaatctctactgtgctgtttctttggcacacatgccccttgggcctgggcatccctctgaggttctgccttggattgcagagcatcgaagctctcttcctttcctcccttccctcctggtgtcctgagattttcttcctccatttgtgtacaagctccagggtcttttattcctctcctatttcttaagtcaatgctgaagcatttagcgttgttactggtatggcaagtgatgttttctataccgtgtttatggttttgttttgatctgatcctttggctctatcctatgtcactctgttgtgtgaggaccttcacctgtacccctgagcctggctgaacctggcccccatgacctcctcactctcaagctctgattgtcctgtgcatcagccctcctgtccagacttggagctcctttctgggctccggtgctctggatcgtggccactttccatacagtactcactgtgctccccctgaggtcttcagaaccaagagactctgcaagggaaggaacacacagggagggagagactcggcacacaatgtgtaaaagccataatgatactctaatctttattttaaaagatacacatagcactatgttcagaggtatttatgtaaaatacaactccttgtgctagaatgatcagtgagcctttttatttgttcatgctttgacataatttctgaatctttaataatacattgctttccaagttataataaaacagtaaacttttttcccaaattaggaattatatcaattatatcaattatatcaatcagtaaaatgcatcatcagaggaaaagcaaatagagattatatttctatatttctctgccttctctctcttcctctctcttctgtttcctcttttagcattcagcagatgcagtgggagctgataccctaccaagccctcagagggagggagtgctgcacacagcattgagaaactgcagaccaagtcaggcatgggagcagggtactgtaatcctagccccgtgggagggtgatgcagggggatggcaaattcaaggagacagagagagcccctgttgcagacaagccagctaatgaagggtgagtgagtgagagctggagaacttcatgtgtgctcaccacctaaattcaaacctggaggggttcggtttgtagccagatccgttccttcatggaaggatggcagagctcaaatggtcacccaaaccacaccagcctaatgcatatttatttattttttgtttttttgagacagggtttctctgtggctttggagcctatcctggaactcgctcttacagaccaagctggtcttgaactcacagagatccacctgcctctgcctcccgagtgctgggattaaaggcgtgtgccaccaacacccggcttatttttaagatttcattttgcagtagccaaaactgagtggtttttcagaaaaacttggctcctttttgtttttgtgtattcaaagatcacgtgtgctaagaaatcttaaaacaattctatccaaatcgtcagctgaggaagtgatgcagagtcaagctttggcactgcatctgttttatctccacgaggccgaccttcaccttcctcttctgttgacccctctgtcttacgctctacaacccctgtctgtggtaggacatacctgtgatcccattatttgtgagggagacaggaggatcaggagtttaagtcgagcctacactatatattatgggctacacgaaaccctatctcaaataacaaaaaatatttctgttaaaatttcttcacaaaagccatttctttccttcatctccacgatgggctctcctcactgttcatactccccttgtggtctttatttgattgtagcttaggtcaccacacacataaatatggctcaggagttaagagcgtgttttgcagaggacctgggcactgctcccaccacccacatctggtcactttcaacagtttataaccccagcttcaggagatcacatgtcctcttttggcccccatgggcactgcagtaacacgtacaaactcacacacacacacacacacacacacacacacacagttgttaaaaataaaataaatcctaaaaaagacatccataggaagctgatgtcacacacggtcatacaccataccatcttcatattatcacaccatcacaccacatataatgtcatatcatcatatggcatattatagcattatcacatatcatttcatttatagcatcgtgtcatatcaccccatcatattgtagcataccgttcaataatatataatgtcttcatggtttcacatcatgttatattgtatcattatatataattcaattatatctcatgatttcatatattgtactatttcatattgttgtataatatcacattgcattgctatgtgttacatattgtattgccatctcatacatcacctcatcatattgtattatgtataccgtcatgtcatatatcatcatatatcatatataccgtcatgtcatatatcatcatatagcatatataccatcatgtcatatatcatcatatatcatatataccgtcatgtcatatatcatcatatatcatatataccatcatgtcatatatcatcatatatcatatattatgtcatataatttcattttgtatcattgtatcacatcacaccattgcattgtagcatatcagtcaataatatattatcatatcttcgtattgtaccatcatttaatataatgttattatatatgtcatttaattatagattatatcatatcatggcattatacaactataccattccatattgtcatcatatcatgtgatatcacgtatcacataccgtcatatatatcacctcagtatcatacatcaccatatcatattacatcagcatcgtaagtcaaatcttcatgtcctacagcatcatgtcacatcatgttatataccatcgtgtcatagcagcttatcactatgtcataccatcccatcatatcatccagttatgccatgatgtcttcatgccagcatttttcatcgtcttgtcgatcatgtattttcatacacgcgtgtatcatataatttcatgctaccctatcgccctgtacatcacaatcctattaccgtatcacagtgtgcctttcaatcatagcgtatctcagatcgtattacatctccatatatcagatcacttcatattttcatatcgtagctcttcacacatcactgtgtcccatgtcacatcagccatgctatcgtgtcttcagagtttatgttcagtcatatagtacaatcatgtgcacacaccatcttcacctctcacgctttccttcctgcttctcgtcactgtttgaaatctcttctttctcacttttttgctgttttcctcatttggaatggagactctgtaaacagggactttataataatatatataataatttgtcatcggggcctgcaaacctacttctgataagcaggataataaatgtatttgttactttctcatcactgtgatagaatgcttgataagaacaacttcagacagaaacggcacggtgtgtctttgcctggtgttttacgtgtatggtccattgtagtgggaatggcctggtgacaagtgtgtctctagctgtggccgctggtcaccttgcacgcacagccaggaggcagagagagagagagagagagagagagagagagagagagagagagagaggcgaggatgttggtgcccagcccacttcctgtttattcatttggggatcccacttcctgtttattcatttggggatcccagctgacaggctgtgccaccctgtgcagcgtgggtctgttctttcttaaacatctctggaaacacacccaaatgtgtcttctagtgtttctaagtcctgttaacaatgagacgttaaccatcacaataggcatgtgttgacttatgatggtctatggactatggtgacgtcacctaggctcatatcaaaaggcaacatgacaacaagtttgagacaaaggtcaaattaacctgtgtgccattctaggatctggcatctcttcatcaacagaatgactattcctatgactttcgtgaaggttgggactttggagagcaagggtctggggaaggtggaggcagggcacagaatgggccagctgtttctgtacaacgggaaagcggggagggacacccacagtgtgtcacagttccacagtgtgtcacagctggttgctgggagtctctcatctctcttgggaactgacctgttcctgagctcagtgaacacccctctggttaggtcaggtctcctgagacatcaggcagtctacaagagtgacctcccgtgaggttcagcccccgtggtacccatgtgaagctttgctgccacatacacaatcattctatttctgcttcctttcaaaatgcatagcaacactgaaatctggcacaactcaaacatttaagaatgcacaatacttaggagaatagagaataataaatctgtgaaatatgacaagattgggggagatgatatgtgtataaagcatttgggaatcggtaagcccattcctcataaatgcagatatccattatagtttacgtgtgtggagcacctgtttctcaagtgctctctagtgctattagctaaacctatcatcaaaaacacttcatcatcttccagtcctatgcactcagtgtaagagctgcaagaagaaagcaggggcattcattaagtcatcccttccttccctgggagcggtaagcccttgctgaatatgtggaggaatgtcaaggccgagggatctctagatgcacttggttagatgctgttcctcgatttactcactcctgaaaaacacatggcaggaaggcttccagcaaacgcgtctatgaatgacttctgtatcatttcacttgggaaagaattctgcctatgtgtctcataattggcgtgtgacctgcggagattaacattgggtagttggttggccacactattgactttccacatggaaatcgcatgaaatgccttttacaaatggttttgcctagtgaacaaacttcaagccagccatccttaaaaagaaagcaatgtaaaaaccattaaccctttagaaagtccgaattaaataaatgtctattttaatcccctgggggcattgtagtgggagtttaaggagtttgatgttagctcaggggtggagtgcttgcctcctgtgagcaggtttctgtcctgaacaatgcagaagagaggcccaggaaaccaaatgctgaatcaaaacaaaatcacctccgtgaactccactgtgttacgaaacagttaatttgcaataagttataacatagcaactattttataaacatttttcacatattaatgtaactgattgtttaatgattccttgttatctggaaggtattattgtagctgaagtaaatcccctctactgaacacatttcctaggtctgagtttctagggtgttagaggtagacagaccacgtaaagaaagcagaaaaaagtgtaaggctgggggccttatctgttagaaaattctagagcctttcatggcactcagaacacgcaggtggagagtctgtgacatttgcaacattaaagtgcacgacgcagagacatgtccttttgtgtgatgctaacccaacctcatcctatttgcaaacatctgatgtttgcagtcatctccaacatggaggaataaagttaatgccggtgagtggcccttctttgttatgaaaatggctaccctgggggtgtccttaaccagcagcaaagccagagaatgcctttctccttaacatcgtgtttggattttgtcaatcttagtaaaactattgtcagagttttaatgtgtttttctcttctgttcgtggggaagaaaaccattccatacaattgagccattggtatttccttttctgtgaccagttccatcctgtgatttgagtccaaccattacatattaggaaatgagctctttgtttggtaaccagttttctttaattttcattggaattttttttcttctagcatgaggaatttataattcttctggggctttttagttctgtgtgagtgtttgcacatgtgtgagcaggtgtgtggaggtcagagggtaacttgtctttgagagaggttctccaccagtctggaacttgccaagtaggttaggcaggctgaccagtaagcccaggggtcctcctgtctctgtcccccgtggtggggttatgcgtgtacaccaccatacttgacttgttctgggctacagtactcagacattcatgcttgtcacacattatgctttcctggctaagctattgtcccaacccacttcttttgaggtttaatttcattttcagaatagcttctgtcagtctgagttgtgccttaattctcagagaattctcatattctgatcgtctgcaccttttgggcgttactatgaaaagccttgtgctccctggaagtgagcatggtggcccatgctttaacctctgcactcaggagactggggacatcttattgtgagttcctcctgtctcacagagaggaaaatgaaggaagggggggagatggagggagggagggagagagacacgctttgagatacctacaacacacgtacttacagctttcgtggtgtgcactcatctttgtctttccagatgactagccaggcctttcttgagggaacgtaagacgtatagctttgttcaagtcgaggactaatggggcatccgagtagtagagctgagttccacacaggaagcttatgtctatactcaaccttgtccctatttaaaaactccagtggcctggggaaatagctcagtaagtgaaacacatgcaagaggtcctgagttcaacctctaatgtcgtattaaaaaaaaaaagttgacactggcacgtgcctgtaaacctacttcccgggaggcagagatcagtgtgcccctggggcttactggccagccagcctggcctacttgccaaattccaggctagtgagagaccctacatacaaaaatgagctggagtccgaggaaatagaggcaaagttgtcttctggcctctgcatacacgcgtgtacacacacacacacacgcacgcacgcacgcacgcacgcacgcacgcacgcacgcacgcacgcacgcacgcatgcagatttatcagcgggacttgggtttgctgaagagcgatttatcagcgggacttgggtttgctgaagagcaggtgaggcttctgcccacatcgtcatccggcagctccagctgttctggttctgctgggctgacagccagccgaattttcctaattaatgctaactctttctgctcacctctcctcatgcctgtcagtgtgcatatccaagcattttcttccgtggcacctatcatggagttatgtgtgttttcagagggtttggtctggcagacaccatcagttactccagctaattaaaaatattcacacaacacacaatatttaatgaggtataaatagaaatagtttttttattacatcttagagcccctgaaaagacttgccatgtccaggaaagttttaggatttataagtctaattaggaggttagccatgcaataaaaatacctgttagtaaaggtcgctcgggtttttttagaagtcgtttttctccagacagaggtcccccaaagcaaagtgcatgggaagccacctctcctttcccacgcgttccttagttactcgggcccctgtcctctggtgacatgtccttaacaaggcagtagttctaactcagaggcagaggagggacacttgtttgtaagaactttcatgtgaccctgattacacgccgcaggcatgaagagtgtctgggcatagcaggtccactagctgtttgatgctgttaactgtggggatttagcctgctgtgtatacaccacaggtcccagaatgtttctagcttgatggcatttaactcagtttggatcacggttttgacctgaaaatgatgctttcatagttaacactcgtgtaaacaagataaaacaaatgctttccccaagctcatcattcctttcggaccccctacccccacccctggtgccctttaaacaacctatggacatcttaactcagcattgtctgtttgatttcaaattaatacctctatcattttgacagagcagagaacctatttcagaaggccatgtttgtagagtttgtttatttttagtttaatttgttgttgtcatgaggtactgggaagtgaaccaagagcttcgtgcatgctgggcacgtgtcctaccacagagatgtgttcccaacccttacaatgtttgttcattgttgtgtgaacacttaccttattttaactcaaatgcattctgctcagacgcagagttaatcttcttttatggcttcaaagtcatgatgtaaccataggctacagtttacatctcagcctgggaaagttcctattttacctggaattcatactctgcagtgcacgccaagataggacaccaggtcaacaatagttgtatagattggggagcagaaaaacctgacactttaggatggtggagtttgttctgctatctctccgtgtgccaccatagtggaacagcagctcataggtggatcacgggtggacatacattgccgtgtgcaaccactcacacaggagactagggctcatcactgaataaattcccatgctcgtcatcagaaattattcctccagcgtttccctcatgtcacactatttaaaaaccattttattattgttgttttaaatcgtgtgtatctatgtgtgtcttgcgtgtgggtctgtgcacatgtgtgcagaccacagaggccagaagaagacaacacggctctgagaagtgaactcagatcctctggaaatatgtacacgtgaccacccggccacttctccagccctacctgctgtgttctcaaactgtcctttgactgtggctgccacctgaagcatccggctcatgccgggaccataagtgtgtggcttgagcagaggtgacaactgtttgtagtatgttgtgaggacagtgaagagctctaggactggttgggcagtgaccctgaagcagcaccgtcctgtgttcaggacgttcaaagcaaatgctgctcatgtgggagacagccggtaaagaacagaagtctcagtttggccgtggaggaagattaagagtctataaaaccatgcgttgctcagcagtgtggaggctgcctgtccttcagggcgcctcggtgcggcgtgggtgcgtaagggatgtgcacagacactgcttgcttcaaagggaaattggtcaggggcagcaggagtctgttttaggatctgggcagcagggctctaggtcagggggctgttcccagctgcctgcgttctgaagccttcagctgggacttgtatttcagttggttccaggctctgtgttggcagcagaaatcacttgttttaaagaggtgttcagttgtgctttctggtggggaattttcatcagcagaacagtctggtctagtattttcctcactgtgtgcaggaaagtctggttttgtctctctctctcttttccaggctacccttccccatctcttcctcacccctctttcctcactgggtcctctcttctatcccgcccctcctccctctcctctcacttctctccccctcccctttctctgtcttgctccccttctgtctatagcctctgtctccctattctcccctctttccttccccttcccttatctttcttcaccttccatcttcttttcctcctcccctccccctttcctctgtctgtccctccttctctttcacgttctttcttcctatctttagattgagaacacatcttctggtgcctgtcaccaactctgacagggtctgtgggtgtgtgtttcttgactgaacagctccatgacgtcataaggaagccccatcctgcctctacactccttttctccctgcttcttgttggatgtagtactggcttccatgtctgtgatttgtgttccattttggaatataattaattcttctgcattggaccttataaattgtgatgtgtaaatgtgtaactatttgcaacaaaaatgaggtctatgggactaaacttttttcgatggagggggctctaggctgtacacatcatgagaaatcatcttttgtttgttcctagccctgttctcctactcaagctcagactgagttgccatagtttctgctattcatttgacactgtcttggattcttttctctcttttgttttatataatctgtgcacaggagtttcagagaaaagtttctcaggcatctgttctggaatgttcttattgggggatggcatttgagtttcagttaaattttgtacaggttactgctgtcaaaaccttttgtccgtcggcaggcggtccattccattcttccacgggcaggcggtcactccatctttacacgggcaggtggtccactctacccttccagcatccagccctgcagacaggaattcagcttccagcttgatctttgcaggcatctctcttctctcttagcactcttaggctttttgtgctcacctggctttgaattcatttgttccatcacaagttgccattctcagttgctccatagagacatgtgggttacacttctggagggtcatagtctcacagtcaggtgttggtggcaccaagctctctacacagtcaggtgttggtggcagctccaggaactgactggctctgacctttctgttagctatgctatttgctgacagctgttggcaccattggcttgtagctcgtaacctgtctctcttccacctttacatggtgtttctccctctgtgcccccctttattctctgatatggaacagtcaatgtggactagagcagagcctaattcaggatgacctccatcttgatgacacgtgtaaccaaatcaggccacatttccaggtgctgacaactcagacatcaaggtttgctttggaaaatgtagttcagcttgacaacattccacagtttcaccagaatgtaaagctctgtgcttatttaatctcattcacaaccactgtgtcctttattcagagacttgacgccctgctccagacacaagaaatttctctttaaaaatgtttattttgatttgttatgtgtacagatgtgtatctgcttctctgtatgtgcatcccaggcatgcagtgccttgagtggccataagagggcatcagatccacaggaactggagttacaggcagttgtaaactgcaatgtgggtgctgggaaccaaaccccagccagcaagagcagccagggctcttaatcactgagccatccctccagaccctcattattttcttaattttttataaccaatgtgtcatttactgccttttataactttcattcgtcaggtctgtatcttcctgtattggccctccctatttcacaacctctttatttccccatttattcttttatgttttgtgttctaggtgattcattggcttcctttttccagctcaccacttttgttctcatccttttcatttaatctttgaaaggtttatttttagagtcatgatttaatttccaagatcgtttttccctctctttaagcgtttttaggtgtggtgtctactcaaagtttgtatggacaataattagaattaaatattgcttatttgtccgtggaacatttgttttcagttgaggtcattgttcttggtgctaatggttttatttgtcatccctgggtctttgtgtggtcatgggtaatgactgacacagggggctggcagtttggaaggtctattcctggcctgtaagccttgcagaagtaagaaaggttgacctggaattctatgagaagggctgggcagatgacataggaaccttccctttgtgtgcacgcatctgtgtattgtgtgtacatgtacatgtgtgtgcacatgtgtgtgcatttgtgagacagacagggaacagcagtgagtgttagggggattttcttgctggctggaatctccatgcatttcctcctgtgctgggcctacccccatgtgcctctccacgtactcttcatcttatggtctttgcagtcatgtcaagctctgttctgcttctctgcaagtcttcaccattgacactctacagtcagaatccttctctgcaagtcttcaccgttgacactctacagtcagaatccttctctgcaagtcttcactgttgacactctacagtcacagaaccttctttcttgagaggagtttttatgcttctccaactttttcctctgggtgaaaacagctgcatcagacttttgagtttgctagtcagagggaggaggaccttcttctcccatgattcaggttgcttcttgagtagctcagatgataccagtgtagttcccagtgtagccaaggccactgggtagacctgtaccaagtccaatcgttcatgggtcagtttttctccaatggtgtagttactgctttactctggtaggaatgctgcaacacttccattttcctcttgacaaggagcatagtcattgctcaatattatggctacataaatctgttatgatgcatatgtccgtgggtcttaaggaaaaaagacaggctccatgtaccaccttcccaggaaggttttttaaagataccttttaactttttcactatttctgctgtcaggtgtttgatcatatgtagttttgtgggcacacacacatacacatgtaaacatacaggtacaccctttaatgaagttaacagcttggaaggatttggctgtgtgttttctgtctgagtttttattttctttggcatctaggaaggtaaagatctgtgtgcttgttgaggtgcttttttatatcgatgttgaaatgagtccatctcacacattaatcaccaagaaatcaaaagggattttgaaggtgcagtgatcacacattgctaattggcctgaagaactgaaatagcttcagcagcttttaacctgaaagtatgggagacgatggtgtggcaaagtttaaagagttaggcctttcttgcatttgttctttctttcttaaaaaagaaaattttcttccatgtttgttagtgtgtttggctaatgtttaaaagctttaaccaaattgagagggaaattcttcccatatttttttctattcttttcatttcagccaaaaatcgtggtattgcaatcccagtggatttggatggccaggttaacacactcttcatgaagaaccattcaagtacggtgcagagggcggccatgggctggaggctctcagctcgatctggacctcggttcaaggaagctcttggagggccagcatgggattacagaaacattatcgagaagttacaggtacaatgaggacattaagagacattactcttttctagcttctgtatcattgaaatgtgtcatgtgatacaatatggttgaaaatatccagttcttcctggggcaaagctttcttctgtagctctctgccaccacctcctcgttagcagtttatggacagattgtcctgacttacttcttaatgagttatataacaacatgttctggtggtttctgagtgagtagtggccattgatcgcaagacaattataatgtcagtaataaagttagtaaaaataacctactgtaaaagacacatgtgataaattaggttttaatagtgttgacccagtttatcttcaggtgtgttcccttatatcccttgggccaaaatcagcccgtccttctcttcaccaggtccttgtgtggcccttttgcaagtcttcatccgtagtctggcctgtatgtttaggatcagtgagccaatgacatgtggctttcattttctgggacagccacaacaaaacaccataggcaggattcttcaaatggcagaaatgtattctcttatgtctctggaggtgggagtctccgatcttggtatcagtgtggtttggtttcctctgaaactgccattcccgactgtggagggcctgcttctcctgggtctttcctctgtgcagatgtacacctgtgtccccatttctgtcccttgtgtgaccaccaccctggtggctcatgtgaactcattttgccctcatgctatgttagtaggtcttgtctccaggttaagtcacatgtgactgtattctgaggttagatttgggggtaattagttcttacaggtgggccccatgaatgtggttagttcccttatactgtagcctgaaagtggtgtgtttgtcctttctaccacatggggacactgtgacatggaccctgcatgaaccaagaaataggcataaaaactgctaatttcttattcttggattcctaactcccaagttgtgaaaaccaaactgtcatctgtaagccattcagctcatggcatttgttgtacaccctggcatgatatttggaatccattgtaaatgtgataggaatggggattcctgcagagggggactgtgctcctctcctgctgaggaccagagtccgactcagcacttaaccttgggtggctcccaccaattgcaacttcagctccatgggagacagcacctctggcctccatgggcacctgcacacagatgtgcccacatacagagacagacagacagacagacacaattaaaaacaaaatcttaaacaaataaggcagaaactgcgttggagagaagcagatagttttcgggacgtgttttctggtagatgggtgggtgaattgtggggccatggaaagaggggtcaaggatcacccctagttagatgtgagtttatcctgggctaaggcaggagacagtgggagagaggaagcttgtggggacttagaattggaggtctgttgggggattctaagtttgagatgcctctgctgatgccgaagtagggctgccggccagatagctgggtgtgtgagtctggagaggtgtggaaatatcaaccctgggtgttctagcgtgcacaaagagggagagcccacagagctggatgagcagtctcagcaggagacgtagctggagcaggaaaaggaccatgatccaacagggcttagtgaagggtcaggactccagcggaaaattaagtatggtgtcacagaatccaggggaaggtggccatggaaaggtgtgtcccatgtagagcagttagattggggtggaaaagaggccacccatgtaataggaaggtgatattcatgactcatgcatgctctgtaataatggggctgccatctgaaatgaagggggcagtgtgcatcaaggattgtccttagaacttgctttaaatcccgcagcaaacctagatggtactggtgtcatgatgtcatgtggggcaattctgattctcagagggaaggaggacttcacctcaagtcagagtgtcgcttgtccaatggcggaagttaatagataataaatcagactggtttcaccagagcttggccatctctgataagcgtcacccctttgtatgacgaacatgcccctttacagaatctttgtccttttaactgtcatcaggaggatgattggaggcctggaaaacgaagcatgttgggtctcttaggaacctggcatcgtgtctacccattggctagatctctaggcaaggtttgtagagctgaatagatcttggctttctacttaggacttaacatgtctccctggtcagggctgtgcaatgttctcctcagacaaagtagagtgaccctggccattataagccctcagccttgatgctgagtgagggggctcatctccgtgagagtattttcgcctgattcggaaatagcacccagattcctttttagcaaggatgggatgaaaagaaactgttagacatgtggccaatcagacctatcaataaatataatttgaaatagtattgaatgtccttaaaccatgcacagtaagctcatatctttgagtaacatatcagtgagtgtttctactggacaagatgcttagctctgggtgaccagggacacataggaaatgtttagcggttgctcatatgcacccctggtccactccaagttgtctccttacacagtgtgtgaagtggtttcactgtttctccctcttactcatgtactctcagaagcctgactgttacctaccaatccattaccttgtgaattgatttaaaagaatgtgtaaggctggagacagcccaggggttaagagcttacactgctccccagagaatgtgagtttggatcccaggccactcacaactgcccgagaattcagcttcagggcgtctgacaccctcttctgggtacccacactcatgtctatatacccttcccctcgtatgtacatagtttaaaaaatctttaacacacacacatatacatacacagagacagagagacacagacagagagagacacacagagagaatatgaatgaatgaaaccagattgtgttgagtgtaaacagcaaacatttggtgttgtgggaagccagggttcatctggcacagaacggccgcgtctcctttctggttaatgtccttacgcgagccccatcttgagaggcactcatgtgggtcctctgtgccttgtctcaggatgtcgtcgcatccctggagcagcagttcagccccatgatgcaggccgagttctccgtgctagtcgacgtgctctacagtccggagctgctgttcccggaggggagcgatgccaggataagatgtggcgcctttatgtcaaagtaagtggagccagaccagggacctttctggtggaagagagagggctgcagcagtccagaacacccaccttctgatccttgccagaaaactccctggacagatgacccacacaaagtcacattaattaaaatttagatgggttaaaatgagataccaccccaccccctcagttacagctctaacactccatggctctacgtggctaatatctaccagttctacactagagtcctgctggatagcagaggtctagactgtgagggtgacggtgagggtgagggcgggaactgactaaagaagctgcagtgtatcagttctggttccctctgaaccaggcagagtgcatggccagagtcttagcttgactattgtccctgctaaccccaccctgcccatctctctgaagagccaagagtgtcatttgcaagcatagctagaaacctagaactcagttctgttactagccacgccacaccctggcactgctgtgcccggcacgccaatgaagccacagcaaagtggaatcagtttccctccttcctccagagaccggatgggctcacaggagtgggtggggacagcctcagggaaggacttggactctgctgagtcacatgctgtgggatgagagaatcggtccagtcacctgccaggcagctggtttaggtccacttaaatcctcatctgctcttgtgaaagagaatctgtgttttttagacgttggaatggagacccacggatggaaatcaagtctgtgtcggcagaggctaatataaagacacggcttaggaaaaaataaaaaaaaaaaaaaaacaaagtacctctcgcacagtgaggacaatttctgggacagtgtgcacacactctggtatcccccatgtcagacccacactcaaggctctttagtccaagctccaccccttctttatttatttaccatttttttgacatggcttccagcctcccacctgcgtggtttgtctacattgcctcctggtcagagttgatttcttgcccttcccccgtccaacatcttctaactcaagtgttacaagagatttttgtccggccttctcccacaactgctttagctcccaaataacacacagatgctatattaattataaaattttggccagtgactagagattcttattggctagctctgcctcaattattaacccatttctattcatccgtgtatttccccatggtcttggcttacccgagaaagcctggtacatcctctcttccagggctcacatggcgactccatctgcctacgtttcccagaattctcttcatctcctagtcccccctatacttcctgcctggccaatcagccaatcagtgttttattcatcaaccaataagagaaacatatatacagaagacatccccatcactcaagtgctgtgtctttgttgatgccttctctttcttaccagcatcaggaaattaccacaacagaataaagctttttttttttttttttttttttttttttttttttttttttgccagtacctctgtttacattttagtagctctcgtcatgtcagatggctatgttcagcctgttgtgtgcaggactgtgtcctgaagccccagagattgtttggtgaatggcagcacttacaggggattgggctaggaaatctatttcctgctttcctcattaggactgtgtaactggaagcaaattgtgttatctgtgagaggctcctttctcctcagcaaacagttatgtagcccgattgtggcttgtggagaggatgagcagtgaggaggtcctccaccctgatggctgaggacattagctggtcatcagccagaggaaatggcttctcagtgacatcccgtggcactcactctaaatggagacttataaacccatgctgctcttgccgtgtcacgggaaaccataattccctttggtctgcatcacgctgttcctctaggaagacgtgtctcacagggtcaggggagggtcagtttcttaacaacccagtctatgggaactgagttacatatcctaatcataaacgttccacttgatactgactctcaggatggctccacccacggtactgaaagtcttcgagagccacactgcgtgcttcaacacagtcggggaaggagccgttcctgtgtctgagttacagcaatggtcaagctgtcttgatgctacacttgtcccttctaatcgcagcagccgctcacatctaccaagcaataccgtatcatacatggcgttaccgagagaatgggggaaagcccactaaactgtggtatcacctacatccatgatattccaattaatgtgatacaatgaatagaaaataataaatgacatgatgacgtaaagtatgctttaaatctttttaaactagcaaaggggaacattggtgtttccctgtttcccagagtgtcatagccccccaaagagctcgctgaggccgggcagcactgagatacataaacaccgcagcgaggtctacaagctttagagacctttggcattacgtgtctgatttaccttgtgccttcagcactgtcccccactcccacgcagcataccgtgtacgtttggatgagaaattggtgtcccttttaaggtttcatgttttgctttcaggctgattaatcacacaaagaaactaatggagaaagaagaaaaactgtgcattaaaatcctccagaccttacgggagatgctggagaagaaagacagcttcgtggaagaggtatcccttaactttcagtactcggaagtagacttgtttcctttcttctccattttgcatttgaaataccgtgaaaggattaagtctggatttcaataggccgttgtacaagtgcttcttactggctgtatgataagtgggtgttattcatgttagccacgttattcatgtcctgtgttgaactgagggacacttagatcacagtggatcaaatgtgcgtcttagccagtgctctgcagtctgtcttggatgttcgtgtcatagtctttgggttctggcagactgtttggcttaaagactttctttgtggtcctgggaattaaacccaggtcctctgcgtgtggtgctcgggtgctcagctgaccaccaagctccacacccagatctccaaatgaccttgtgagatgatgagtgattggaatgcagtgtttagattttgcttaaggtgcaacagctggtggagagtgtctgtgcacgttggctcgtgtttttaagtcagaattatgcttatgtcatttttgatagtattgtgtcaagtattgtaagataacactattgctctaaatacggggaatagctggtctctatttttagctgtattaacaggtgcatagttgatattcagagacataccaacttacagattgtcatgcagttattaaaattgacagttctggtgctcattaaatggtagccagccgtgttctaatacccacagtgataggcttaaatataaaatagaaatcttgaaaagtttttctcttctttttgaagggtagctacctacttttatgttaagcaccaaaccaattttctataaaagtaccttgttgtatttgtggagtatttccaaaaaaattgctaatcctctggtattttaaaactgtaaaggtttggtttttgttagtagagacacgtgctttctaatccctgaaagtctagggtgattggatcttgttttcttagcatgtcttttaaaaatgaaatggagtgcaacattggttgtcagcagggagggctttgcttccaaaccctgcatcaacctggtagcatggctctgttgctatagttcttgccacccaagtattggcacctgagttcagctcccagaaccaatgtgaaaagctgggcatggtggcaaacatttgtaattccagagctggggaagcatagggatccctggccagacaacctggcctcctgggttagttctagacaggtgagagaccctgctcaaaacacatggctggaactggtggtgcaacacctacagttgcacgcacacgcacacgcgcgcgcgcacaccccccccacatcctgatagaattgagtatttactaatcaaaatgctttctgctttagtcgcactatttaaaactatatttggacaacaaataattaagataaatgtgaccagtgtaattttagcaatttttttttcacgtaagattgaaggagaccttacacatttgagtataagttatgggcgttttcaggatctgcagtcgttctcctgtggccctcagtgcagtgctgacacttagccgacttcacggatgaactaggtcaccaagcagaacaattaggtcaacatagttttctcgacaagccttccagtttgacagagcagatcaataccgaatgttctaaaagaaggaaggagaaacatggggaccctggtctcagcaggtgagagtgttttagtgtcttccaagctgctggctctgaaattaatcgcctgttctccctaccccatcctcctcacgctactacgtcagcctccctactccctccttccttttcttttgtctagaaaaccccagtagttcacacgcgggcaaacatgcatggactcttttaagccccgccttcgacaccacacatgcatgcacatacttatgtctatagcacacattagaaaaataaagcaatgtagtggctggagagatgctctgtggttaagagccctgactgctctcccagcacacacatgactgctcatgactatctgtaactccaggagatccaatgctcttttctggcctctgagggcaccaggcacacacatggtcacagagacacatatagacaaaacaaccatgcaaacattacagggagggagagagggagagagagagagagagagagagagagagagagatccaccttccttatttggcgctgtgatgaagcactgaccgaaaaacaacctgagtgaagaaagggtttacagcccgtcatggaggagcaccaaggcagaagccagaaactgatgtagagaccatggaggaagtctgcttactgccttgctctctccggcttgcacagctagctacctctcttatatatcctggtctgctgcctttcgatggtgtcagctacagtgggcggggcccttccacatcaattagcaatcaagaaaacgccccacccacaagagcccatgggccaatctggtggagggaattcttcaacttagggttcttccctggtgtgtcaagttgacagcctgggttagccaacacagcaccccagacaagtagagtcagataaacctctaagaaaatattagaggggtgtgtgtgtgtgtgtgtgtgtgtgtgtgtgtgtgtgtgtgtgtgtgtgcgtgtgcgtgcgcaagtatacaaggaaacattgtcagaaggattattgagcagccgagctcttacttatcctgctgattcccacatctcccaagaacaaagtaagacagaaatatgagtgtaagactctttgctttaagccaacttcttctgtgtttgaagttgctgacacattgccccagggagttgtaggggacagtgtgggagattcaagcgtctccagacagcacaggttgccccggagtccactggcttcttaaatacctgatgcttagtgatctttgctggtggatgggagcagagcgactaagcctgtgtgaggtagtgctggggaacatgctgaccagagagactcctccaccactcaggaggggttgcaggggaaaactggttcagtggttgggcaacaggcaggtccttcataattgtcttacttcccggttcactgacaccgcagtgtctaaaaatgtccaaattcaccatcacacacatgtggggtgaaaggttaacatcaggacaaggcaggggtacatgccctctggaggctgttggctgtattcatttcctagtcctgtgtgtcttctagaggcctttgcatgccttgtctcatgggccccatcttagttagggtttcttttgctgtgaagagacaccatgaccacagcaactcttacaaagggaagcatttaactggggctgactgtaattacagtccggggattcagcccattttcaccacagagggtagcatggcagcgtgcagacagacatggtgctggagaaggagcagagttctacatctggatcctcatgaagcaggaagagagagagacactgggccttgcttgctcattttaaactccaaagcccaccctcctgtgacacacctgctccaacaaggccacacctcctaatggcactacctcagctttcagatagtagctcatagagacctttgtcatccaaaccaccacatgcccttcttgtgtcttcaaagccagccactctcccttcttgttctctcccctctctcaagtgccactccttccacacaagactcccgtgttcttggaagacctgtgattacattggaaccacttgaaaaatctgctatgatccctgccccatgctaagatttttaacttaattttatatgtaaagtgccctgcttccaggttctttaactagagagatcacaagccataggcatgtttgggggaagcatttaactggggctgactgtaattacagtccggggattcagcccattttcaccacagagggtagcatggcagcgtgcagacagacatggtgctggagaaggagcagagttctacatctggatcctcatgaagcaggaagagagagagacactgggccttgcttgagcatttgaaactccaaagcccaccctcctgtgacacacctgctccaacaaggccacacctcctaatggcactacctcagctttcagatagtagctcatagagacctttgtcatccaaaccaccacatgcccttcttgtgtcttcaaagccagccactctcccttcttgttctctcccctctctcaagtgccactccttccacacaagactcccgtgttcttggaagacctgtgattacattggaaccacttgaaaaatctgctatgatccctgccccatgctaagatttttaacttaattttatatgtaaagtgccctgcttccaggttctttaactagagagatcacaagccataggcatgtttgggcttggcagttatgtagcccacctcaaatgtgcgtgtgcacacacacacatgtgtagctgggggcgtgcacacctttattttgtgtgttgaagggtttgtaggttcaaatctgaatggagacttccttgagacagtgaagagcaaagacagtccagtagggtgggagggtggggtggagccgaggtagctgtccgcagtgtccagtcaggagatgagatgcccagttcatggagatggtaatgctacctgtgaacccaggtggagtattaaataaaatagcacacacaaagcattaagagaagggctgatagacggtaagcttttcataagagttagttaccattgccttttaaaaaccaacaccgagaaggacgctatggctagcatgccactttggaatgtgctgtagtctgcagtctcatggtttgatttctcagatatgcagagaaatgagacaagaggttctttaatcttgataagaactcacccaagtgtgggagtgtcatgcatttcttcagcagcttgctgaagaaatccttgacgatttcagcccaagttgaatggaggcaagatgaagacagagctgaggggttttgaagattgaatttttacaaacattcaattatgctcagacttccctcgactcctcatgtcgtgggctgagttgttttcagccagagcattagacagatgtaaacagtgtgctgtgtgaggccattgtccacagcctctcgtggcagcatggcattggacaaacagcctaacaactagcagatagctgtgatctttacagaggcccagctggggcagacagcatttacacattggactgggatagcaggcagaagtttctggatttgacagctttttatctcagagtgatttaggagaaaattctgtcagaatttattttctgtaagaaaattctgtaagaaattatattaaagatgcccctccccctctaaaatttgctgtcacttgaggtaataataattgattcttttcttcatcaggaaaaaatcataactaatcttccatttttgattgtgagaagcaccaaaaagatgtcagaataatactaagcaccttagttcctaccccagacgccgagcctggcagtcgtcaccataatcctccatgcaaatgaatttacaacaaactctgctcctaagaatgtgtttgccaggtggtggtggcggcgcacgccttcgatcccagcactcaggaggcagaggcagaggcaggtggatctctgagtttgaggccagcctggtctacagagtgagttccaggacagccagggctacacaaggataccctgtctcaaaacaaacaaacaaacaaacaaacaaacaaacaaaaaaaccaaaaaccaaaaacaggatgcacttgcactcagccacttctgtgcatgtccttggcctgctttgtagcagcaggcagataaaatacattttggcaggaatgcaatggaatgagcccatgacttaaaaacgtcatccctattttgcaaaggtgaataaacacggctgtagtacagctgctcttcagtgcacttctgttcttagtaagtgtctttcagagatgaatagaaagttgttttgcaaggattctagtattttaaactagagcagcagtaactcggcaaacctgaagacctaccattcataaacgtgtgtgtgtgtgtgtgtgtgtgtgtgtgtgtgtgtgtgtgtgtgtgtgtgtagatacacacgtgtgcactgtctgtgtgctattgtttaacttggtgtcagatgtctacaagtatgaaagcgcgaagccgtctttggagattgactttagaaacagaatgggcacagtactccacctcaggagtttgcattttgttttctcatctgggcaaaacgattgttgaatgggctaaaaacactggtagcttttataaatgttttcttttctgtcgctggtctcgccgagtttggccgaattgctgtgctctatacggaaaagactccatgctcttcacaccttggtgttgcttgcttcaaaatccgagatagctgcatccttcctggtcttgagtcttttcatacaactgagtcattagagattacagctggctggagagctggctcagtggttaagagcaccagctgttcttccagaggtcctgagttcaattcccagcaatcccatgtgggtcacaaccatctataatgggatctgatgccctcttctggcctgtaggcatatgtgcagacaaaactcgtaaaaataataaataaaatacacagagattacaggtggaaggtcacaatgggcatcttctctgggctcagaccgaccactgtccattgtctctgtgaggctgctgagatggggctctcattaacaagctaaactgggtaacttcagaaggcaaaggcaaagccaaaactgcgaaaaagttaactgaagaaaaaggacaagataataaaattaaggtattgttgaattatcacagtagtcatttccacctaagtctgacataaactcttctccagaacatgccccatgacgactttagcttcagtttgttctttttgaaaagaaggaggaggaggaggaggaggaggaggaggaggaggaggaagaaaaagaagaagaagaagaaaaattagttgatttgattcaggggctcactatgtagccctggctgtgctggaactccatatgtagactaggctggccttgaattcacagggatatatatgcctgcttctgcctctgccttccaagtgctggcattaaagtgctgccaccacacacagctttgctttataaccactgtggcatttatggtgtcattatttgcccgattttgaaccttgctctaagattccttgagggtgttccctttagcgtgtgtgctgccattttaaagaaactagggacctgttgagagtgggccagacttgacatatgagctgaagcccccacatcacccctgcagagctgagatccacaaagttctgcacccccacccccaccaccccgctcatctccacccagattcacaccctgtttgagagcaggctactgatcttcactgctaagcttccggtgtttagcacttggccatgcacacagccattgctcagcaagggccttgccatcaatagctgtcagccagcaccagccctagctgagaagcgaatgctcgaaacatcacttgaaatcctgctttgcttatctttgtgttcctggaaggggcaggttttgtgggcttcacacacccgcagagtcagaccagctgcccaggcttcagcacagaaggccaggggtgcaagcggggtcacccacagcagtgtgctgttgtagtgtgcacctactgtgtggcctgtgaagcaagaaaagacggagggtgtcagacggatggacgctgtgcccaggagcagtgggagggactggaacaaaggcaggaaggatgtgatgagcagcggtgaggaggaggaggtgcttccattccagcacctgctcccagccttgaggagaggcctggagagaatgtgctagagactcagttcgtgaacagagaagactcagcctggaggctttgagcccagagaaagccccctaccaaaatcagagggcttgaggctgtagaacaaagacactgagtgagatcagctactgtagcagcctgactgctgaccccagacagtgttggaaccctaacagcaggacgtgaggcagtaggtctggtgttgctgtctttcggagaaggaacagagtatctgcagagtgcaccaggcatcccatgttttccatcagatttacccgttgcaggtgccaagtggatggcaacaaaacctggctgtcaccttgttctccagccgttaccaatgtcatatctagaggagctgtgggctaggtaacaggctgtctgaagtcactcagcactctgcaatagctcccagaggccacggagtcctgaactttgttttatgactaagacaagaggtgggaggggaagtgtgaatgcaaatcccagtatctcttgcccctgtctaacatgttacataatggagccaaggattaaatgatgtcagtgaaacaaacagtgctttacatttgattgaatcttttcaagctggagccgcagactcatttttctgcccgtgtttttattgattatcataaggtgttagttcaaatcaagagtggcataaggaatggctgttatggaaggctaaaactggccctagataaagtgattagcctccaaacccacaaaacaccagtctctccacaatacatcttagttaactgatttgaagctgccctgagcagtttatagtacaaagctaatctttgtgtggtgtttttcagcttagtggtattaccacagtccaggtggactcagcattgtggagacccaacatccttttagagacttcagagttcactagctcaagcctgaaatcctatacaggaagctagatgaagcctatttctagaactagttagtattctatatgatcaataatatcacaaaagaaagtttaaatatgtatatatatattaaatatatattaatcttataaattttgagataatatttataccttaagaaaagttttaaaaagtcaaaacaaaactaaagaattatgagattagtggcaatagaatattccctaatttgggtttttctcctgtcccatatcaggtgactcttctgacatgagacagattttggattttactttaacaagcatgcttgggtttagagaaggagagagccatgctccaactccaaagccagctttcatttttaattggcttgggactaggaagagaccatttgcatatatgtcagtagagagcagtagagacaaacctttgggaaggtttatatgagattttatcctattgtaattgtgctatctcattaggccaatttactctttttcttggggaattttttttttctgcatgattgattcatccttcatcttcagatgtcttatctgtcctgtggtctctagattccttagttggatacctttattctcctgcaaagacaaaaacaaaaccctaccacaactttaactttagagtttccccttttgacaggtttaatggccatgatgtttgatgaactgttacctctcataatcaagagggctctcctgtttgcatctagtctttatcagttttgatggtatctacagctcttcctctcctatggaaacaaagccaaaacctgttccccaacgtaacacatatcctggttttgattctgaggtcaatacatctttcaagtatacaggctgatttagttcagtagttttcttctatccagtgtctctctgcaactattgttcctttcttttaccctaaaaaaatttaaagttcacagagtattgtgcaatctaactctgggagtctttattacccctttctgtttcttaagcttgtcttttaaagtgtggtatacctgtaatatgttttatgttgtaatatgcagaaaattatttcattttactagagacatatgctggaacattgtcagtcttaatttatacaggtattcccataatggccataacttctaacaaatgtgtgattatcaaatcagcctctacagaactcaaagcagttgcccactgaaaatactgtgtatgtatctatggtgtgatgcacatactttaactttctaaactctgcaaaatgaaatacatctgtctgtcaaatttaatttctttgaataccctttgtgtttcttcctgcaagtagtgggatttggttgtataaagaacaagtaggacatttccttggcttgttgccaagtgaaagaaaattctttcttcaaactcttactattgacatggtgtttgtcatgaaattctgaggcttctagcacacttcctaccagtagctgataattttcatcattacctcatgcaagagggcctggtagacccatatggtatctgatatgtattatatacaagggataatttatatttttgattatttattgcaattgaataaataggaaagtttattctgaattatatggaataatttcagtggcttcaatatgtaaaacaactctttatgcaaattgagagtcagcaactacattaagaggttctggaaaaactaataataccacaacaatagcatgtaattctgatttatgaactaaatcataagggccttgaggcactttacttagatttcatgacttataacctgcctttccagaaattggtgttccttgcacaatgtgaggaagaatccaattaattcttttattttggggatatttgttactaatctctcccaagaaattactgcaggctctttgccagtgttcattttccatccataatgaggaaatgtcagcattaggaaaaagcactacaatttcttttgtgtcagtttctgttaatttatgacatacatctcaattttcctttcagaatcagtgcagaaaccctttccacatagatctttatttatttatttatttatttatttatttatttactctgtttgtgtggtaaaatacccattctaaaatattatcttcctgtaggaaaatgtgtggaaggatacagtcaaactggattcaagcaaaccacatgtgcatcccatagtttcttttctgccacagccaattctttctaagccttaccttgtaattttcttgaactattgaagtctctatcatcttgtaaagattcaaataaattacttgggttttgagttgttaatccaattgtgggctgtagctagttaatatttcccagcaatttttgtaaatcattaagaatgtgtaattgatgatttgtactttctggggttgaattttttgtaaacctatccaacatcctaattaagtaatagaaactctgtattttttctggagcaatttgtaacctccatcaaggcagaattttccttgcttcttcaaacattttcctcctaaggtatccgtgtctgaatcaactaggtagatatcatccacatgatggtaaattatagattgaggaaacagtttacaaattatttccagtgactgttgtacaaaatatggacacaaggtggtgctgtttaacatcctttgtggaagaactttccactgataccttttaacaggctggggattactgtaagtaggcactgtgaagacaaatttttctctagcctgttcttgtaaaggtatggtaaggaaaaagtcaatcacaaaagtagaccatcctttaggtaatagagaaggtaaaggaatcctgggctgtaaaaagcccattggctaaatcaccttatttatggcttttcctttcttccttccttccttccttccttccttccttccttccttccttccttcctttctttctttctttctttctttctttctttctttctatttctttccttccttctttctttctttccttctttcctcctcctcctcctcctcctcctcctcctcctcctcctcctcctcctcctcctcctcctcctcctcctcctcctcctcctcctcctcctcctcctcctcctcctcctcctcctttttggtttttcgagacagggtttctctgtggctttggaggctgtcctggaactagctcttgtagtccagactggtctcaaactcacatagattcgcctgcctctgcctcccaaatgctgggattaaaggtgtgtgccaccactacctggccttatttatggctcttaaatctgttaacattccccattctccaaatttctctgtaatgacaaatataggagagttcccaggactggtcagttcttcaatatgttgagcatttaactgattctataccagctgttctaatctctgtaattttatgatgtcaaacctgactgttccacccagacagatttgtcaggtaaccattttaaagatagggctgttggtacctttgaaagatcaccatctgttctgccctgctcatgtacaacctcaacagtctctgaccacccttaatacattttaatatttctctcagaagcagtctttattttgtggtttgtttctgagatggggggagtgttaatctgtgttttccattgccgcaacaaatcacagccccataaattcattgctatgttggccatatatggtttggattttcctgtctgtcctggccctatgcattcaatgtatctagcacttttttttttttttttttttttttttacctgagatacgcagcagtccaggaagcccagctcccagggctgcctgcgaggtagcaataggaatgccttcaaggaagtaaggatttggggggaatttcctatctatctatcagggctggaactgaaaagcatcccaagcctaaagatacatgttctcttcctgcatatagtcccgaagcacaaggagggaagcttgtaaatttttaatcaaggctgtgggaccagaccgtcttctgcagccctggctatctgtgaaacttttccccatgtaaagttgttcccctctggacttgattaattggttgttatttttgtcctccatacaaatcttaggactgtaaagcatgaacagttagttagctgagcctaaaattttgtatcacaaactaaggttagaagtttgtgcagaaagctgggtgttggtggtgcacgcctttaatcccagcactcgggaggcagaggcaggtgagtttgaggccagcctggtctacagagtgagtgccaggataggctccaaagctacacagagaaaccctgtctcaaacccctccccccaaaaaaaagaaaaaaaaaagaagtttgtgcagagtgttaattgctatggaacttagtagggaggggcttctggtctctgttatcagccaggcaggatggaaactggaaagtgatccaggtctctctgtgtctcaaagaccttgatttaacaaagcagacatttgcatccctgatccctgagcattatctgtgaaaagtctaactcataatctgtacacagagactctcaatctggctaatctccctatctgcctagctaattgcccagaacaggtttctatgtttctcactgttttgtgggacaaaggcttgttttaattaccagaattacacagtgtggggagaagtcatccttctgtcagtgcagagaaataatggtgccccaaaagtgaggaacatacttccaaggttgtgggacaaatcccatggctattttaggggggatcagggtagtacccaagagaatttcaggcagaatcaatcctgttattcatagacaatggatccataaaccttgtttatgagtttatcctccaccagataaattgtttttctcggcgatcgaccttatgaatatcagctgtcatctactgtgtatctttctggacaccaacagagatacagttccaattctagaggttgaacatgtacctcctgaaaaggccaatctgaatgctgaaagacccccaggcccctaaggggcacagggtcccgaggagcccccgagactcagaaaccagaccaagagctgcaaaagcaagagggtttattgaacgaatgtgcattcaggtgtcagcaatatcgggaaagctgcacaccccagcatggggtgcaagctccttatataggaaagcaccgcagatcagcatacaggcaaggggcacaaagtgattgattacaaagtatgatctcgtgttagagaggtcacccaggtgtgacctgcttttctacaaaggaaaaaccacagaatgtaccctgaaaagtccctgattgtctgttggccagccaggtgtgacccaaagagggttgtcttggcgattgccctcgtctaaaccataggatgtgcccggggttggggccaacttccttgtcctgggccaaggcctgtgggaacctttttctctctgtgaactaaaatctttcaaaacttttctctcagcaaactaaaatctttcaatgccaaggttttgtgaaatcattgttacatcttcacctgtgtctacaaaacccccaatttcgatgtcctttacatgtatttttagctttggtttctgatcatttatagcagtttgccaaaatacttgtttctggtctctcctgaatgttttgttgtatctgtggaggttcttttgtctttggacatatccagggcagtgtttttttttttttaagatttttttatttgaattagaaacaagattattttacctgccaatcccagttcccttcttcctcccgttggcagtgtggttttaaataacaggatctgactcttttaattgctctgcaaatgagtttctccaatggtgacagggaatgattgaaccctatctgatatgttgcctgcgggaggccactcagggcattttctgatggagaattgatgcatttcctgtcccatgttgatcggcatccattagtccagtgctgctctttacctaccttctgcatattgcacaaggctgggcctggtgtctggattatctcttaaaaaaaaaaaacacattgtttctaggagcatcttcctataattccttttcaaattaccttgtctatcataattaaaatgtctgatattttgattttccttaaaatttgtagaaatcccttctcctattaaaacagcatcatagcttatgatgccacatcagctgtctttggatccattcatctctgtgtgctgatcttacctttagaggctggatcaccataatcttgcattctgaattagcattctcaaaagccaaagattcagttagtgtttgcctaacttctggatctgatatcattccatttacagctgaggtcaatctttgtaaaacaaaacaaaaacaaacaaacaaaaacccagtggtggtttcttttaggccttgtgtaattttagtaaatgactcagtcccctttcctgatccttcaaccctgtcccaagcattcaaagctgctgtgtgacacaacaccaaagtgtcatcatcaaatctagactgttttctccctcaacgagaagctgctcttgggaaattgcaaaccctctagctgtattcccctgttctgtggccctagcttcctttctctgccatgtttcccattgtaactgaggaccagcttccaatattgctgtagctaaatgtctccagtcttgtggaatgatactgttcctagtggcccatgaatttaacatctgctttgcaaagggtgaatgcataccatgaatcttaatgcattccttaaatctcttcattccttaaatataacatttctccaggatcccaggtaacttctgcatggccttgatggcagctaccatctggtggtcattctcctatgctaactggataaattaaggttgattttctgataaccttgggccattcctcttcagtttcataatgtaatggtgtggtaggttctgctctaaattcctctgtgtctgagtatttttcttcttttcattagtaagtctgagacatgtcttatcagtaataagtctttctaaagcttgattcttatcaatgaatagtaagtcaaattgtcatatttgcacagtcttcaaaccactttttgaggacaaaatatgaattaccaaactgacaataactatgaatgacattatgtcaatcccacctaagttgttttcccctcatttaatttttcatttgccagccatccatagtagccctaaatagggtcctaactccctgcattgtgacgtttcagattcttcacatggggaagattccatcttgtctctttttaaaaacccaatcccccatttaaaaattcccaagtgtcttatcagctctgacgatgctgacatcataggtggggatgtatggggataattaactgcagtgaccatgctcgactgtgtctgaaggagggcaggtgcactggggaccactgtggctgcttagtgttgtgtggggagtggggtgagctgtctgaggagctcaagcaaggaaataggaaatcagtaggagaaatctgcacagcggggatacagcatgggataggactgcccagcttgctgctacagagaaaaggcaagatgcaaggtgggagaaaaccaagctgcctgctgggagtgtcgggtagggtggctgaccagcagtatactcagctggctgttgctgtgctgggctgaagacacctgcttgtgcaaatgtggggctgagggtgtagacaacagctagctgtggtagaggtcactggcagtgacctcagccgggttcctcagctgcatgtggccatggcagcagcagtaaaagcccaagccctgagtgggtctccaggcagccaaactggcctgggttgatggcccagggaggggattgggggagaaccacatggtgggaagtgaaggcatggggcggtggtgggaggctcatttaggtggtgttttggggcctggtgtggacagcagctgacaactgatgtagaaagactgcaatgcaaaaatcccccagatgggagaaaaaggtgcagagggattgtggggagggaactaagcaggctgctatggtggtggtggtggcaacatggtgggctcaccgccttggcatggcttaataatgccaggtgttggatgccaggcataatgaatatataaattgttccagtctaataaaaacccaggagtcacaaattgagataaagacctggtaaatttgacctctctccatggttttcccaaaccatcagccccagaaattccccctggaaaatccctcttctctcttcctgtcctctctagcagacctcctcattcatctaagaactctatggctaatccctgtcagccaatcgctgactctgtcctgtgatttaaggtggctttgttgtcacagaagaatggctttatgaacaattctgcaacattagagtccatgtcccaatgtgggtacctctcattttgttgagatgtcaggccacagagctgtgggatgctgcatgtggctacagagcaagagtgatttaacagtgtagaacacagaccacatttcatttgtgtctaatggtttttgaacatctgccatgtactgtttccttcagcatccgaattggtattggcatcagtttgtctcctgcttgttccacctggtgcctgagactcttaagcctttctggatacttcttccttcaagcaaaaggcaccaagagtttgaacgtttgcagatttctcagtggagttgtgaggctcatcttttcacagtcattcttaggttttgtttgtgttgttaactacacttcaaactacagactctactgcttacacaacatagcctggggaagacaaaagaagtgtgataggaacacaacacggtggcttggtatgaggagcccagaacatgacgtatctaatgaggaccaggggataatttggattggagagggcactggggctgagggtatcaacacagaggtgtttttctttagtgatctctatccaaagttccgagtctacttcctgtcctcttgccgtgcaagggtgtatgtagtcttcgggatctgttagtcccatagaaagcagtaacctcctactttgccactgtgggattgcttttaacaattcaccatcaggatcacgccatctattaccagcgtgcatatagccattgatgccggagaaacaggctgtgacctgtggagagttggttgtcttgtgggcagatccagactcttaggctcattgtcctgttttttgaatgacagttctgacagtggttccatggtgcttttccctgtcagtgaacagagcaacccccaagacccctgggcagccatatttccccagttctctgcacccctctcccaagttcctcttctctccctctgcaacctgtgcccgttccctgagaggtgcctttccaaggccagcccttttattgaatgggaattttctcccccatcctccacctggaggaaacctgcatgtgtgcaggtttccactgctgccccagggctgattcctctcccatttttgaaattcttaacaacttgatttttgagtgaagaccttggactaaatcatcttgacacctgtcacatccctccattcatcccagacggtcctcatgcatatctagttcaacaggaagttcccacagctaatactctggcctctcagctcctgacctcggcatcatcagggacctttcttctccatcacctacctgtcatttctcgcacctacaggagctattgcatttgtgcagccactcatccaggagtcccagcacccaggtctctgctgtgcctatgctggccatcctcagacctaatcaggacctcagatcccgctaacttctcacctcctcagctcactcatcctggtgtatgtcagccttagagttaatagcacaagccccactgcccagcatctgaggcaggagactccccatcatcattccgaaggaaatcagggggaagggtgaaggtggggagtcataatgagttcaccagaccccagataaatgataaataggtcttttattggggatgaacagtaactgtcgcggctttcctgctcgaaggatgcataccctgtctctcctatgctctccaagacccaaaaggggcttccatccccagctcctctatcttaaatgggtcacatccacacctgaaaccacacccaaagggtgtggccactgttacaggttctcaggcaagatgctaccacagaagggaggcaactcctaaggagttggagagttgttgacaaaacacaagggaagagatgtgagatgggctccaagaacaaaagaacacccgcttcctcccgagagcgacttgagcagatggtatctccagactaagttagctggctgggttttctgctccctccccacacagcccctcataccacctctctctctgaataaacagactttccaaagttctctttcaagatagcgtctgcctctttgcacacgtgggcaccgtgtgatcttgggagtgaagtggctgagggatcctaaggctgagaacatatgggcagcagtattgcttcttctcagagtctgtgcctcctaacaagacatctgctgggcactctcgtcttggatcataagctgttgtttgccaattgttttcataaatattaatctccgagatctcgactgacatacgagttgttctttcggattcttttcttattttcatgtgccatctttacacaattgtgccaaattacagtgaaaagggattttttaaaataaaaaattcctatttctaaaatgggggttacgaaatgtctaaagaaaaaaaatgtgactttttcctttacattgagattttccttctttttaaccaaatgcgttggctatagaataatgctttcgtgtttgtttgtggaagtgggtaattagcttcagtctttgcaaagcaccccagaaaggcattgtgtacttgatggaggtaattgttctgtcttcctctaaaaggaaaagcgaatccatcttagtctggaactgtgaattgtaaagttggatcatggttttggactttgagtagttctgatgttctaatgtgttgtgatttgacaatggaccttccccacaagactgtgtgtttgagagcagtgttctccagcagggggcgccgatgagcaaggtggtggaagcttgaggtggtgcctcagtgacggaagtagctcagtgcagaggggccttgagattttatagtctggccccgcctcttgtctgtggctgcagacaccacgtgaccgatcctgccaccatgccatcgggtcccttttccctcaggttactgcttgtttggtcacagcaacaagaaaggtaactcatatatatgcacatttgattgatacgtaaattccaataatcacaggctcactcagcaagcctgtgatgcaattaacaggccctctgcccgagttgctgttttacagtggtcggcagctctagtgggcgtgtgtggctccccactcccttcacagcccccaggaagattttaactcacatacatggggaggtgtggaagttaggatccaccagacccagtataattggagtggagtttattagcaaacagcttacacggggaacacacacacacacacacacacacacacacacacacacacacacgtgcgcgcgctactgaatcttggttcattttgattatgtgtggcacccctggttcatttaactgtttcctctagaggccggtgctcagagcactttaaatgatcacgtgtgatgctggagtaatggaatcattttaatttcaagactgaacggtgttccacacgggcacttgatttgaaggctgtcagggagtcggtgggtcatgcgacactgacaacaggaaagaccaggtggtgaaatttgggggagctatgtggccctgtcactgtatttgacattctccttaggcagcctcctgccccgccctggactctagttggtttctttttcaaaggcatgtttaagacccgcccctgccacatgcatgtgtgtcacagcttgtgtgtggagatcagaggacagcttctgctgttggtccttccaccttgttagaggtgggggtctctgtggtttgacgtgttcctgcttagcgtctactgctggcttgacacagcctagagttatctgagggagtctcagctggggagtttcttctttcagaccggcctgtgggcattttttttttcttgctatttgatttaggaggaccagcccaccatgggcaggactctccctaggctgagagtcctgaactgcctaagaaagggagctgagcaggagggaacaaaccatagtttctgtttcagttcttgtcctggacttccttccctggtgcactgtgacctggaggtgagagctgaaataaatccctcccctaagttgcttttgttggagttttttttttttttttttttttttttttttttttttttttttgtttgttgttttggtttgtttttgtttttcgagacagggtttctctgtgtagctttggaggctgtcctggcactcgctctggagaccaggctggcctcaaactcacagagatccaccttcttctgcctcccaagtgctgggattaaaggtgagcgccaccaacgccctgcttgttggagtgtttgtcacagcaacaggaaaaacaaaaacaaagaaacaaacaaaaaacaaggtggctgctacaccacatatgctagagactctggccctgtgcttctggggactgtcctgtgtccacctgtcctgtgtccacctgtcctgtgtccaccccattccagcgtgggagcccttgcaattacagacttgtaccgccacacccagctttacacaggttccgaggatccaaacccatgcaccgaaaaccccttcacccactgagccgtcccctcagcctgacatttaagatcttgagaggagatcttcatgagagatttggactttctttcatttcttccgttgttcattcttctagaaaatacagtgtcccacggtccatgatgaaaatgtatttcttcagctccatgtggattcgcatgagccttctgtgtagagaagggccactgtgccctgctgtcttttaaccaagttggggttggggctccctttgctctgaggcccagtagaaagttcctttactcttccttgccttccattttctgggagtcaagcacgatgccttgtttacacatcactttgctggtgtgcaccaggggtgttttctggaaggagaatccccatgtgtctgcagagtgttatctcagggagaaaggtggatatcacacacagcgtaaaccacaccacaatgggctcagatgccccggagatgaatattctattccggagggtgcactgcatggcagctagccagcccacatggctaggaggatggttgggttgactggcgtcctctggctcatcactagctaccacaaggagggtcatgtggacaggtgtcaggtgtttggcgcctgttacatgagggaatgaaactgttagaattcacagcatttgtcatacagagttctgcagaaagagtggcctggttaatggtggagcatgaaaaatgaatgacccagagacagatattgggggtcaagcctcaagctgaagatcagaaaagcaaagcagcagccactagctcttaactctgcctcagttcagaccaaaggggcaatcgtcaaactgctccccagattcactaagactgctatgctctcctcaacgtggctatagaaattcctgagactgactactgaagaccctgttcctatcttttatatctctctagctctgggactaaaggcatgagctctattgctcttttagactgattcaatctcatgaagcccaaggtggccttgaactcagagagatccatctgtctttgtctcctgagttctgggattaaaggtgtatgccaccactgcctgatctctatagcttgaggctgactttgctttctgaatcctcaggcaatcataaacagtatgtccccacacagtaggaatttattttcttatggctccagaaatctaggtgaaggtgatgatgaggtgttttcttctgagggtcatggggaagggatctgccccgggtttctctggtgggcttgtaggtggccctcatgtccccttgtgtcttcaaccatcctgtcttgccgtataggtttatctaaatttcctcagtatgacattagtcattcaggatgataccagccaatgacctagttttaatttaattatccatttaaggatgatttgttcattcagagctaccaagtggggttggggcaccaggacttcaacctgtattgtggatggaatctgctcatcccaatgccatttctttctctgatctgctcatcatcatgggctgtgtgcaaataaatgtttgctgtccgcttcttatgctgaggacagcgcagtagacagccaattggtggcacacactgcagagctagttaggaaggtgtttctaaacagttatttaagcatgttcaaactaacagaggaaacctgacatggtttctgctttcccaaaagagctgattgacaggggggtcccgtgacactgagacacacactttccctccctccctccctccctcctctctctctctctctctctctctctgtgtgtgtgtgtgtgtgtgtgcgcagaaagttgggccatgtactgaaagagctaagtagtatagaaaaaaaaaaaccaatatgggaatttgaaaattgacagaaaatgttcccatggtagtttttagccagcgatgattctgcagtctccccgatttttattgactactttttatgttcgatgttcctgatcatgaagaattgagagtgggtaattgggtagtatctttgatatctcctctttgctacaaattaaatgaagcagttctgcttggctatccttttgacagcctggtcgtttccatagtaaaatatgtatgtaaaaatgctttatccagggccttgatgctagcttctctgtagagtttcacctagggaatatgatgcctggattccatactcactggtgcaaaacaagcaaacaaacaaacagaaatgcccttaattgaaaaccatgtcctgttgggaagcaggctccctacttcctataagttttcataaatcacagatgattctcctgcttgttttggaaaatgcaaatctttaaacagctggtggtcacttctaagactcatataaagcaggcgctaggaaacaaagaagacaacagcagttgtagtgactgctccagcggcgtttcaatgggccattccctatgtccatatacgagagaaaaacggaagaataaattctcaactattctaaagaaaaaagtgactcatgtcagtatttcatgagcatcttggtttatgcttattgtttctcatagcaacattttattttcttgggtctaaaaattttctacatcaattatattttattgagtttactcttgccagtagagagtaggcagtcagaatcagaacagtaaagctggaacctaacctgatatctcagtcttgcaataccagatagctagaaggctgaggcaggaggattataatttcagaatctgcctgagttcaaggtcagcctgggcaagttagtgagaccctgtgtcgaaataaagagtaaaaggtctagggatggagctcagaggtggagagcttgaccaatttgtttcaggacctaagtttaacccgagagcctccacatgatgaatgaatgaatgagtgaatgaatgaatgaatgaatggataaatgagtgaatgaataaaacaaaacttgaaggcatttgcagaataatagcgctatcttccaatagtgcctggtggtttttttatttgttttgttttgtttttgtttttgtttttgtttttctgcagcatgcaacactggtttgttctttacattgcccagttattttggtggacaggctatggcgagacatattaggagaatcctgtgggtgttggcaatagtctgaaatacccagatgcagaagcaggcttgtctggttattaagtagctgtcttttatctcactccttggggcattcaggagagaaataattgactgtaactgatttaattagccgaatgcactttgcattcaccagcaacccaaccctgagaatgctgaccattcagtattaaatgtggctctgacttgaatattgaaagtgcttgactccagacttagctctggattttgtccgtcctcagctcttctctgactgcatcaacagaactccgactaggacaataaaatagttcaggacagaaattatcctcactgccagcttattgcagtagtcccagctattaatatatagaacatgctgcccagaggagctatgtcaagacagacttttaagcagatccgtgtcatcttaactctcctttgtggagactttaagtttgaggctgacttcagagaagccccatggcaaacacagctcctagaattcgaagtagagaagtagagaacaggaaccctcgagtgtgtggctgatgggcgtggtgaatccaggtggcttctagaccatagggtgggtcaaggacatttgtagccctagggatgtgtggtctccacagacaccagggctggcagagcaatgatccatgtgaggcaaaaaggaaaactggatcaccatgactaggtcagtggtgttggttcaagctttagagtctgacacccaggcagtttatctcagccgtatttaaggacagcaaacatttggtaatatgtttcctgatgttgtttaactcaatcctatatgtacagcaaacttaagacatgtttacattgaaagtctttgcaaagtacatacagcttctttcttaaagatggttctgttgactgagaaacaattctgaagggtctagggagaatgatggaggaaagcataaagtcttagggagttgggtgtggcctggccctactgataacacagaggttcctacgctgttataaagtgcacggggcatctcccctaagcatgggctctactgactgagaaacagtgctcaagataaagcctgggtagggagagtctgggataaacatagtctctgggctttggatgtggccctgcctacagatagcacaggccatcaggccattaacggcacacattcccagctgtctgggtggaaacaggcttgcatctcctccgttgaggacacaaccctgtctgtttaaccctcccggtttccctggtgctcatctatgagcacaaggaccttttgccctctacaaagggaaggtcaagggatggcattttgcaggattggtggggaagacaatctagcatggaccccaccacggcagacttttactgtagacaacgctggcaatagtgcttccaaatgggaacatggcccaagagcatcactcatacagtcttaagtattctgtggcccctgggtctctccgaggaattctgatgcactggtttctagcgagtcggtgagaagttagttggttcttgtgtgaatgagaaaacagttgctcaccgtctacatacagctatgataaaggagcttttctctttgtgttggtctacacagaccaataatgacattcagagtaaatttagaaaatgaaggttttgctttgtggcagagtgaatacctgccatgcaccaggccccagatttagtcctcagtgtcactccatatatgggcgtggctgaggacagtgtcaggagtggagacatgggtctctacggttctcattacatcacatcacccctgcggtttcttctgcacctaggtttccgatttgctgtctgtccttgatgcagacagctggggcaggtctcaaatgtagttctgtggcccccaaacagaatgttggcacctctggttctgcttacatgtgtttgttagtgctggggtttggcgagcccatttcagttcccttcttctgggacttgagtcacagggggagtaggtgatattctggcggatgacaggacattgccgtcacatccatgtggaggagccaagaggtagatctgtgtgttcacaagcatttctcccagactcaaaaggacagcatctggccagagaaaagcccagaatcctcctgcctctgtggtccaccacacaagctcctcccaccagagaagggttgttctgttctctcagaaggactgagagattgcgacggcactaacacaggacagccctgcacctgcatttgcccatgaggtgaggggtaaggctactcctcagggttcagtgtcctcacagtttgtccatgctgaggccaccatcctcagagaaatgccgtgggtgcctggttttgtaggacacaatcgagttctagctggtttcttcatagacgtatctactgctaaacttcacatggtgtccagttcccccatcctgagtctgcttctttcactcaagacagaggaccggtagcagaggcgttccacggcagactgactgtatgtcctctaagatgagtatttggagtagtttgtcccagcaagtccaggagcatacctgaattgaaagggattcaatttctcctcccctgtgtgcctgattaatatttttttaggtctcagctcagagtcacagccagtgcctttcgtgatgaggccgtccgacatagctcttcatttgttgatgtcttagggagtttcagcgagtgcccactgttggtctcactcctgttaccatggtctgtcttttcaataccactgtgactttcatgagactcagagctccgtgtgttactttgtttgctgtgtatatggagcatcttgggctaacccaattcaataaagggcacagcttccgtgacgagaaagggaatgtggcaggctgcatcaggctgagagcaagggcccagaaactgtttaccactgcagtgggcaacacacgactcctgtctggtccccgaatgtcagatcccagcaggattgttgactgtgttgacctcagttggaggttgggtcctgggactggggttatactggtctaaaaggtgggtgaaaattgtgtctcatgaatggcctgggaattgacagagaagggacacttaaaagatttatgtttactgccttaggtatagagatgttttgtctgtatgtgtgtatgtgctccacatgcatgcagtacctgtagaggcctaaagagggcatcacatcctggcacctggagttgcagagggtcctgggctgccatgtgggtgctggggattgatggccaaggtcctctgctagagcagccagtgctcttaaccactgagccatctctccaggcccttttaagaagtttagaagggccaagatcatcgagagaaaaacacctcagaagatcaggaacattgcctagtgtggagtacacaagggaatttctgcacattgttcaggacacggtaccttgtgtggagtccccatgtgggctatgaggctgtttttctagtcctggggtataagtatggagtgttccaactaccttctggaaggtctgatagtcagagcagtgagagtgaaattcatcttgcagttagtgaacttttttttttttccagacagggtttctctgtattgttttggaggttgtcctagcacttgctgagtagaccaggctggcctcgaactcacagagatccgcctgcctctgcctcctgaatgctgggattaaggcgtgcaccaccattgcccagccagttagtgaacttgaacttactggattgaggtttttgatgaggactggctcttccaggcttgtcctgctacaatgacattggtgagagacacccaagttggagaggtcagtagacgaggactgtagctgtgcaggctggcgcttctgaggtgtgtgtgaatctggtttctgatcaaggatgactttgtatgcctgtccccaaacccgagctaaaaagtattaaacagaagatgtagaatgaaacagagatctgggctttggaaagtcttggtgatgcagaggtcacagaagtcacagaggtcatggggacatgaaaccgttgctcccttgctggtccctgtctccttggctcacctactggtagcaatatttacactgaaatcttttaaaaattacttattattagagcagtgcttctcaaccttcctgatgctgtgaccctttgatatagtccctcttgttgtggtgaccccaaccataaagttatttcactgctatttcataactgtaattttatcactgctatgaatcatgaatatctgatatgcagggtatccagtgtgcaacccttgtgaaagggtcactccacccccagattgagaaccactgtggcagaggacaactccgtgaagttggaacctggagatcaaactcagttaccaggctaccatgactgtcttgtcagccctggaatcattttttaagcacaaattatttgtacaaaataatggctttgtttttggcattctcttgcatgcatataacgtattttgggttgttttcattttttaaacatttatttatttatttaacatcttgactgcgattttctctccctcctctcctcccaaccccccctctccctcctttctgttaatgaacagactatagagctgggctgcaataccatagcctgccaaaaggtgtcattgttccataaatgatatctcagggtagctgactagaagcctttaaattatgtaaatgtttttatttcctctcatttatattttgaattctcaccgtatgaacataaatattcaaaccagaggagatcaaaagctgttttacctaaatctagttacaccaatatagtcaaattttattcagaattctagtcattggtgttaatttcatacagttcaccactgcttaattttagctactgtaatactaagttaccacctttggtgttattttgatatttggtagagacataggtacatcttggagtgataaaaaagtgtgtatttttgactttttttctgtgtgttttgtgggttctctttgtgttcagacgagttttccgtccttatgtcacattcacaccaacacagattctgtttttgaaaataacaggcatatatttgcctcatacctagggcagggtcactgtgtgtagatagatttttaaatatttgagtaaatgaaagactagagttcatttggcattcagtgtttttatactagggacccgaattagtaataaaatgccagagaagacaaggggtgggggggggagggggggggcaggtggtgggggatgggggtcgggggcaggtggtgggggtcagggagttgggggagatgtttatacacacccatcacatacatgtgtgtttgctcagtgttaacaagcctaataacattacttggagactagatatacttagcatctcatgatagcatgtgttctctctgagccctgggagcaaaagcatgcatatctgatatttgggattattgttccctgggactcatgttgggagaagcatttatgattgacagctggctatacctgttgtagcatcttaaattaccctatgtagtcccaatttaaaggtttgtttgaaagggcggggggggggggggggttgtgtagtgtagttttgacacctgctttctccaagacttgtgacctccgtcctgatgtgatctgtgttccttgtgattggtgttactgaattctgcctagcggtaggcagggaatagtgcctgccttgtttgctgccacgaaaagtccccaaacacatgactgcacatgaggacactgcagattagagctgcagggtgtggctgggggagacacggacagctgagccactgaggcgctgagccactgaggcggcggctctgccaacagcagcatgggttatgtaaggcctgcagtgtctggagctgggcttcactggagacatgtcacgtgtgtgcaatgctgtgggtgacccgtgagtctgcctgagataagcttttgcagctctctgtactagaaagcagatactgcacataatctaattccagtaagaacagttgctgtctggctgtcctttgtctgtctgtgtgtctgtgtgtctgtgtgtctgtgtgtctgtgtgtctatatctcgctacgcttctgaagatcaaaaattaagcattatgtaatgtggataaataatgtagtgaaaggaagcaactcagttctggtcactagagaacttatccccacatcacttaaaaatgatttttacaacgactcagcaattattacaaaatacatagtatttgggcattgtttctgggaatttatgtagacagctgccatcatttcccccaatgccatgatctgtggaggagagaaagggagtttacagtttagggaacagtactgagaaagaattttaaattgtgagctcaagtggaattttaatttttaaggtttttaactttatttgtgtgtgtgtgtctgtgtatgcaggtgcccacaaaggccggaattgggtgtgagaccccttaagagcagcggttcttagcctgtgggttgtgacccctttgggggtcaaatgatcctttcacgggggtcacttaagaccattgggaaacacagatattttttacattatgatttgtaacagtagcaaaattacagttaattagcaatgaaataattttatggtgggggtcaccacagcacgaggaactgtattaaagggtcctcgccacgaggaaggttgaaaacgcctaccctagagcctttgtcaactacagacccatcttcccagcccctcaaacagcctttcagattttatctccttactgaggttatggaatcgggacctgtcagaaatgaaccctttgtatgcagctgagtctctagactgcatctcccagaaggagatctgggtgatgccggaagacagcagcggtcagtgttgggagactgaagcctgggaaagagggtgagggctctttcatgtgaccctggccttaaggagaacccagaagatagccaaactccagcttggctttcctgaccacctctggcttccatgctaatgtctgtgagcagaaatcaaaggccctgaacccaggtgcccggagtcctccagtctgctgagtcagcagggattagtggcgcaggtctgtgattttgggtggattctcttaaactatagcaaaaccaatgttgtcctattttttccccctcttacgaaggtcttttatttttgtcttattctttaaaaccttcttgggatggtgctggtttgttgaatgccactttctcttctgacctcttcatatgtagattttgtctaacagtcaggcccagattatcaccattagctctttggtagacgacctcacccatgtggaacatttgacacacacgtgtgtagcttactctccctgtcgttggaatgcatgtttgtaggaggcatgattagtccattgaatgaaaggaagctggacagggccaccctgccaagaggtgacagggtgtgggctgcaaatggaccctaagtgtttcacccggctgtgtgaacggtccacacccatggttactttccagggccgtgctgactactttcatttaggatgtaggtcccagaaggtctgcttttatttttttaatttccgtgtgtgtgtgtgtgtgtgtgtgtgtgtgtgtgtgtgtgtgtgtgtgtggggatgtttgtatgtgtgtggatatgtgtgggcccaagatgaatatcagaaggcatcctcaggtacccttctaccttcttcctgaagcagggtgtggcagggagaccagagccctccccatggggctgctctcccagcttgctgtgcggctcccggctcccgtctgcctttctgaggttgcaattagagcacacttcccatcattcccttggattcagggagccggagccccgccctcaggtttgtagggaaagctttttgtcttctgagcatctgccttgctagccccaggggtgctctttaaataactccctgggtggctctgatgtgacaggcatgtcagctccctgtgtatcggcatcagagcacagacctttatgctgagcttgtgatgtggatggaaatggttgaacccgccatgtctggggcagggctcagtggtgaagagcacatcctctcctgcagaggacccttgctcagtttccagcgcctcctggaggccacaacttcctgtaactctggctccaggggatctgttactttctctgacttcttgcgtgttcctacatgcacacagtgtatgtccatatactcaggcacacacatatacatataaataaaatagatattaaaaaagaattttgtctaatgtgattttgtggtataagccactaagagttaacccagagacaattccaaggttatgggagtgtgtgtgtgtgtgtgtgtgtgtgtgtgtgtgtgtgtgtgtaggttatatgcaaagaccatgctgttttacacgaaggcctttggcactcagtgatgggatgcgcgcacgcgtgcgcgtgcgcacacacacacacacacacacacacacacacacacacactgagtgtacatgtatgtgcacatgtgcttttccattcaccctgtatgcttatagccaaactatgcacatagttcattccttgttgtttcttggcgaaagcatagtagaaactataccttgttaggacagtcacccagtactcttcggctaaagctgtggtgctactctttaacagctgaaaggacacagtaggaaatggcttgtgctataaaaaggctagctagcctccagctctgaaatcgagactcagtgtaacttggttaatgagcagattcagagttggtctaatgagttgctgacggaagggcagctcgttatcaccagccagtgaagttttgctcttacatctttacacagtaataaaggagctggctgctctgcctcctgccattgattctggcttcttgtttatatcttttcctggttttatttaaatgatagaatagatctatccctgggctggggtctgggctccccaacctctttcttgtattcacccccccccccacattttgtttgcaatgatcatcttgttttatgtttccatatttatttcaaaggtggggagtgttggaaaaggcaaaattaagtctgtgattcaggacccctcagcaccatggctgtggccttgtaagcgtcgtagaggactctgaggacaaggaatgaatgtaaatgtttttctaagaacgtggtcacaatggtgcacctgtctgctgcacaacaacccagaataaggtttatattttttaaatttaaattttagtatgtgtaccacataataaagcaacccttgaatattattatggttgctgttattttattaccccacttatggaaatcttatgacttgtacacagacagtggtagaggacttcgtggactgcttggttagtgctgctcatatggccatgagtgtgagctcatctatggacaacctaccagcgaccgctcccttcctccagcagccatcaaagtagctgtcagtaactcctgagctgaggcgaggcctcagtagcctgtctctctctcccatgataggactgtgaagtgtgccctgatcatgtgctgtggtgactcataaccgtctcacccagaaggcggcattccgcagaacccctcccgtgctcttctaagtccagttctccctgggccttgggtgtctagtttgatggaggtgggtcctgggtccacctggaaatcttcttacaacttgtacgcaaaccatggtagagggctttgtgggttgttgatactgggagagtcaacttttctttgcaaatgaaccaaatattgtggactttgcataaatgttggagatgcccaaattgtgccctgaatgaccatggtaacgaggcaaaggaaccatcgttagggatcttgcttgggtggagttcatttgtctgcttctgtccatagaaaggaagccgctggggacaaaatccacatctttctggcattttccaagaccctattgctgggttaacagagtatcccacccaaaaagactgtgctcagctaccccagagagggatgtgtgctgttcctctgtgaaccgattctctccggttcttaggtgcttccacaattttcaaagttacagcagctcatagaagatctagaccctgcagattgctaaccagtcaaactcacaaacagtctgtgcttagaacgaaaaagagttctttgatgtgtcagttgggcttgaattaggatatagaaaagaaacgacaccttaacaagaaataacgacgtgaacattcaacatggaacggaagcagtgcatgtcagaggaacactaatagcaagactcggtcacggtaactaggaaccgaaacaacagaatgctaagagaggactctgaagtgcccgcagcagtttcagaaagcagccgcctgtacccagaatagagcagagggctggactggaaatagcagttacagagcctgcctgtgactcagtcatggagcacatgcctgtccggcatgcagaaagcctggttcgatgttctccaccgcatgagccaggtgggtgatgcacacctgtcatctcagcactcaggaggcggaggccagaggatcagaagttcaaggtcctcattggccacataatgagtctgaggccagcctggatacagaagaccctgtctcaaaacaaagccttggaggaaagccctgtggccgcctacctcagagcccagaggcaagtgccatggacagagttttctgagggaaaggcaagtcactctggtcaagaaacacccttgacctagaagaacttgtgtctggggtgacataggacacgtacaaaagcaggaagccacatcagagccaagtcctgctctcccgagctcatgtgtggtgcaaaagcagttgcttggtcactaccaggatgtttctctgagacccttaagagaactctcgcaattaaagattggcttaaatatacaatttgatttgttaacacatggcaaactataaaaatacaatgaggccaggtcctctcctgccttcttgccctagccctggttctccccccccccccccccccctctctccccccccccctccccccaccacagtcttttgagtcttttcccccagtgttgttagcgtcttaggcgccctttcaagtgtgtgcagactcaagccaacactaatgcagacccttcgatgctataccacatcccgctgaacacagaagggctttacactgcttccccaccagcgtgtcttcccatctcccctgatctcttcgtgttttaaatctcagcactttgagttttcctactgtttttattgtctttggtacttataggataaaggggtttatctaaaaatactcacagattaaaaaatatcttcaagtcaagtcttctggctaattgttttggactgtacacatagcacacgtaagatatttaagatgatagcagacatcttttttgtcatctcagcttcattgaaagtgtctagtatttcccaccaaatgtaatactggcaaagcgtgtttcattttgttaacgaatctcctatctgcctctctagttctcgtcggcctgtctgtctgtttatgcatattttgtgtatacgttgtaatcagaatgagattaagtcttgccagacggctccagagcatccctgtggccatgaagcttttctttttatagttatctcgagcaatgtgttgccctgaactcaagtttggttaatgtttcctgacacttctggtatcgagtgtctttgtggctcctgggacaaactacactgggttgtggaattcagtggcaacacgagtacatctgagcgtggggtgatgtttgtaaatgtctagatatttttgctctcaatcaggatttttaatcacttttacttatttcataagacgaacgtgggtagttttcttattttcttctaacctgcagcagtaccatagcactgaagagagctccttgtacatttggtggaacttccctgtgaaacactctgagcttgggattctgaagtcattcctagacagttatttcttctgtagaaataatcctgttaggccattttctgtcttgtttgatttgatttgggcaaatcacattgttcttcaaaactcacacattttatccaggcttgttgagagttaagttggtcagagcagatcttacaattattctccatttcttttgttttctttttttccttttcagaatgttttgtgtaaagtctgttctaaaatcaggctgtctggtggccagcgtctttctgctttcaaagagtgtgtttctagaacgttatcgttgccgtttattcttccagcaccgcccccacctgcttctgcactgagccccgtgtctaacaaccagcttccccactgactcctacgtctgtgtggagcccacagtctcttccttctccctttcctccttccttctcttccttctccctttcctccttctcgtctcttatgtttccatgcctttctagaaattctaaggtttagtttgggtttactcttgttttcaactaaacaacgaaaccaaacaacaacaacaagaacaacagtttgcagtcatcctgtgggctgtcagttgtgtgtctccaggcttcctctgctttggtacatttgtgcgctgtgtccttcaaactctgtcctggtcgtcatcgtcatcgtcttcttcttttccttttatgttcatttaactttcggaggaattgcttatgttgctttgttttctgcacccctcagcttcctagcttggttttgtcgctaattatttgttaatttctgaagacatgattattactttaatttcctaatatttttaccatcccttccttaattatgttttttggttgggtttttgcctttttgctttgcttttgttctgcatagtgatattgctctaggggtgatgacagcatcatttaagagtgatttatttatttttattttatgtttggcctgcatgtatgtctgcgcaccatgtgcctgcagtgcctgtgatggccagaagagggtgtcagattccctgggactggagttacagatgtttgtgaactgtcttgtgggtgctgggggttgaactctggtcctctaggagagaagccagtgctcttaaccggcgagcaatccctctgtctccattaacaatagttttacccagtaaaaccagcaaaaacaattccaattattttccaaaccatattcttttctatgtgttgtcaataaccacatttaaagaagctgtggctaaagattgctttaaaattaattttcctgttaagacatagtttcttagtagcagaaagaaatagatgaggtggaacccaagctcctttggtgggctgtacatagtaggtgagctgcacacagtaggtgggctgcactcagtaggtaggctgcacacagtggcagctcctgaggctgaaagctctcagataataacattggttacataagtcacccaggatggcccagtgtactgttatttccagacagccctggaagaaacatgtgccaggcaacaggccgtcagacgaaacataacaatttactttccgataattatctttgcttagagccaggttgggacttgattgatccagtacagagaaatgtcttcttgtatggatttctttcgggattagaaatacgactgccatgaatattcctgtgaatcactaccagggcttcattagaggaggcagctgtgtgtgagtgcttcttcgtcctttgtgtgtgagactcagctgatacaaaccctgacccaaagtgtccaccattgcccttccctccctcccatttccttttttgtcttttgaaacacgccagcgtgttggaagccttttccgtgaaaactgacaatgctaagagcccaactgaaatttacttgctagttgacgaatcacagttcacacagcagcacggctccgaggcggaggctggacccctagctatactaatgaggggccttcgcttctcccaccccacaccctgtgctgtctggggctgctctgtggtcctgatatgggccagactcaggatacccctgctttcttcaggttactgtattcgaaggtggtggccccacctggtggtaagatcagcaatgcagtctggtttgctctgtctccttcgtatgggggaagcctagccttggcaagcctcggctggcagtaaagctgagagtcatcttctgtactattgacaaatgcaggataaggtttggtggtcttttcgatactcacgttgcctgggaagaaaagctcccctcaacttctccccagaggttagactaggagcatgtgcgtcctaaggagtctctattctgatggaagcagagccctttcaggtgcaggctccaagtgactctcataacccatgaggccttgtgagtgtctgcgcagaggcttagagctaaaatcctctgctggctgggaggtctgacttgggaaatgaggcagagggcaggggaggcgaagaggtaaccatggattcgttcccagtgtcaaagccacagactgcactgacttcatcagagacacaagaaccagtgcatggcccggcttttctgagttctgaaaacaacgtttaattatgaaccctgaaagtggaagtgtacagaaaggattggaaatagaaaagttgaacgagacacgcttagacaaaaagtaccgactgtctactactcagtcccagagacgcactggcaagcaattaattacaccctcagagtttagtgagaaaatagtcatgaaccaaatatttggagagggattgaatgctttaattactccaggggaaaagttcagagtgttagacgggtgtgtaacacgggataaggctagaaaggagtgtccggaagaattggcgtgacacgataaggaacagctgctgctcggccgtgaccaccctgtgatggtggtgtcagttgaaagtcctcttcctctgagaggctggacacccaggggcagaagggcagcagggaaagaaagagagtggtgagccagccgggggacagcaggtcactgcagggaaggatgctggcatggggtgatgtccgtgctgttaggtgttctctaggctgagctgtttttttgtgaacatttaccaagctctgctctcagcacttcatgtgaacattttctgatggccgccctcacagttgtcttcatttcatatgaaatgaaaataagctgtgttcttaaaaaacaaatagttgggaaggaaacaatacatggctcaaaagatggctcggtcggtgaagagcttgccctgctaacacaaggaccttagctcccataatccccagcacccacacaaaatgccaggggtgatggtgtgacctgtaatcccggtgctgggaggtcagagacaggacagttcctgagtcttgctagtcagccggcctatctgagtctgctaactccagggtcatagaagaccttgtctcaaaacaaatacagtggggaaatgactgaggatgacacatgacatcaacctctgcccccacatgcatgttcacacatgcacacgtgtactgcacataaatgtatgtatgcacacatacacacacatatacatgcacactgaacaacaacacagttggttcttgctgctaagcaagttgttggcttcctgtgcgtgtcacatgagagaatatctgtgacatgcttctggtacacagtgcagtgttcatttaatttgattagaactttaattctcatcttgcccttgctggtctctctacaatgtctagactgagagatacaaagaaccccactggcttcctgtgcggctcactgcctttgccgttttatgacttgtttggtagtggatttggggtcatggatgaagctgatgtcaggatttggggacatggatgaagctgatgtcacagtcagctgatgtctttttcctcctctaagcatctttgttattgttatagtttctgttacagtgtcttgctatgtagcccaggctggccttgaactctgtagcctaagctggtctccagctcctgatggtcatcccgcctcagcctccttagtgctgggatgaaaggtatgtgccatcacacagtcttccaaactcctggagatgtaaatcgacaggctggtcaggtctgaggtgtgggaagtgtctccattcttagggaagctacacatgtttgtctcatgctttgtttaattctgaaactcttggcgaagactgctgttgcttgtacgccacatctggaagacatgtcgtcctatttcatgggaaggaacagcgggccgtgggcggaggagcctgggtgtaattacagtgtgcgtttatttggaaagactagcatattagcatgcagtgggaggattaattaatctcagctggaataattctctgcagttggtttcaataaaagctgaatatctttaagcccttgaggttcgcattaaacttatgatgaaagatatgtttcaaatgtccctccttctgacacgagtcctaaacggacatccctgatctgagatccggcttttcctacctcctccaaaccttacctactaaccgatgaaaggaagtcaggcatcttcaagaagatgagggttttttgttttgttttgttttgtttttacgcttaaaaataaatattttgcaaagcccgatttccacaaagttgtgtatgattttgagtttctcctccgggtgtgtgaggtttccatagaaactgcctcgcctgtcttcagagccatggactgtcttcccacacaggtcaggaagcgagcagtgccagcccccagctcagattattgtgctctcccaagtggccggttcctaattggcacatgcaattccatatttaattagcagtacgagtctcactacactttaccagcagatgtggcatttagaacgttggccatcctcatgcagctgttagccagatgtgcctcagagaggaggcatggtcacacaccacagctcagctgcttggcaaaaatctgggcagaggcagcattatttccccttaagttaaaagaaaaaagtaattttccttaactaggctagtggacttattttctatttttataactgctttattgagatactcgtgtcataaatttgtcccaccagaatgtacaattcaggagttagtttttctccctctctcccagtctttacagcaccagctcctggaagccagctgtctactttgtacgaatctttgtgaattctcctgttcccgatatgtttttttttctaagttttttctcattgttcctgtgctgttctcagggcttagccatggggaggcttgtgttagtactctgggccttttttttgagaaataacacaccatggtatgcttatagtgcatgctactcgcctactcatcattccgtggccatttggggtgctttctgctctttgactgttaggaatgctgctgcttctgctatggacatttccataccaggtttttgtgtgaaattcttttttgagatcaagtttcattatgtagttcaggctggcctcaagctaccaattcctttgcctcagccctcttgagcatgggaactatagatgtgaaccataccctgtggtgacattttgtttatgatctaacaaataaaacttgcctgaaaatcagagcgcaaggccagccacactagtcagtcacagaagctgggcagtggtgacacacacctttaatcccaggactcaggagacagaggcagatggatctctgtgggttcaaggccacccagggctacatgagaatgaatccgtctcaaagagaaacacaggtgatctcagcacaccggatccctggcctttaatcccagcactaaagaggaatataaggcgggagaagacaggagcagaatgagtctgaggtttggtggatcgccccttcgttctgctcatcggcagaggtgagaactctctagtggctggccgatttgtttctcttaaacaaaatatcaccacaatacccaagtttttttttttttttttttttttttccccttggtcatgtgctaaggagtgaggtccctgggtacaaacataactctgtgtttaatgtgtggggaccgtgacatagttcctccgcatggctgctctattttgtatctgacccataagttatgaggttcgtaatttgtccacatccttgactgtgtgctgcattgttaccttgtaaatcttaaccatcctagtggatatgaaggctatccaggggcatttttttttttttaaaaagaaatcaatatctagttcacaaaccagttaaatgcttcttatttatgtttccattactctggagagttgagggaaatgcacttcttgtgtatatctacaatgttattttcttttctgattttaacacaaacccaactcagggaagatgacgttaaaaaaaaaaaacaaaaaaccgatgattctgggagttggactatttggtaggcctgtagtgtagaaagaggaaagtctctaagcactgtttgaataaaaggtaaaatcttcaggttcctggtataatttcatcttacattagccaaatgggccatacagtggcatcatacagtggcgtcatggagtgtgaagcacagtgacgctgggccaaagaccttcagacagggatgcagctaggtgatagagtgcttgcctagcgtgtgtaaggtcctgggttcaatcctagctcccaggattgaacaaatgaccctgatgtttcactcaatatattttatcaggtgtaagaccaaaacctctcgtatcactaaaaagcaaatcaaggcttccagagtctgtagcacactgttgactttaaagtgacctgtagttggtgaaggtcagtgttgaggaaaaggtgtgtgctacagctaatgacacacggcagcacagcctcccgtgcaccgtgggatcttaatgctgcattgagttcatcaccaccctgtacacatacgtgcactctcagcccatattgggagcatctgtgtatctgtatgatatatacatccacacatactagagacagaaaaggagggaggaggtaatgtgtcggctcagcctcgacagactgaaatcatcctcaaatggctcactcacctccagtcacacttggtttgagttttcttagcctgtgaatagtgttcatgtttcaggtagaaactgatttcaaaagcctgtgacgatcacgtgtttgatgcaactggggaggttggggaggttgcagctgcggtccccaacagcgtgtgtgctgtgcactggctgttgttaaaagtaaataaagtctcaggactggggcctggcttggtggataaagctcttgccatgcaattgtgaaggcctgagtttgcatcccaaactcgtggcaaagccaggcaggcatgtgggccacctgcagtcccgctcctgggaggtagagccacggactcctcagaccaggctggctaagcagaccccagaaaacgaaaacataaacttcagtgagagcctctgcctcacacacaagacggagagcaagggttatggagacacacctaatgtcaagctcaggcttccacacacatgcatgctcacacacagcacccctacacacgcgcgcgcacacacacacacacacacacacacacacacacacacacacacacacacacgcccacataggtgtgagcatcacacagaccatatgcacagacacagaaacataagagaaggtttcacctattttagcattttagttactgttctagatacagtagtaaaatacctgtcatggcataatgtgtgacacagagtcaagatgattttcagtactgttcaaaagcccgggaggcacctagcccaagttctgaacaagctccgtcctgaggcgggcagccagcagtgcttgggcggtggcattgttctgtttatttgaactgagatctcattttctccaggcagtaaccgtgtctgtgttttaagatgttgttagatatgtgagaaccctgttgtttattcctcctcatccttgtctgtgtttttgctgtggagtttttcaaaagtcatgctttctacacagaacacaatcaggagctcacgagagcatggactattcatattaacaggaaaacgtatgctcttaggagcaaattaatgtaggaaattattaacacttcatgcctgtaacactcaggttgagatcaggctacatagcaagattctgtcttaaagataaaaacaaaaattaccaaagttagatcaacatgattcatacagtattaaaaacactatagttgtataatacagacttgcaagaaatgcaacagtttttactttgagaatcacatgggttgacagattgcattaagaatattttcttttagaacagcattttaggagaacagtggctgtctgtctcattacactcacagattcacgtgacattgagttgttagtttgggaaatcagaacctcaagatgggcctgtgctttttagaaaggtgaaaatcctgggccagttgatagcacagcaggggtggatagggctgggtgagtatgcaggggagcaaagggctgtgtgagtgtgcaggggaggatagggctgggtgaacaagcaggcatagagatgagaacaagacagttagtactgcctctgatttgtcttcccttagagatacgtggatatgtagagtggtttttatgcagcaactggaacggcgcctgtctctgtggcccaggcattctgatgtccataccctcatcacttccctggacaaaagcttgcttttctttaaccattaaagagaatgctcaggagctgtctgcttagaacttgatgtagccaaaggcacaatgtttctcacatatataacccccaatctttaaataatactgaggtttggatattatcatgcacagtatctgtaactgggtctcaggacaggtcagtagaattcttgagtcacagtgctagtatgtagctaaacccagacctgagccaggtggggaggtccacacagaatcagcaatttccatcatgtgtgtgaccttgcagctcaggtgggtctcccaagatgaagggctggaccgtgtgtgtgtgcgtgtgtgtgtgcgtgtgtgtgttcttaattctcaagaacttcctttgaagttgatctatgcagagttcttcatttcatagactccacgattatttctcttctacatgaaaaattctaaatttaacctgaatttattaaaatttagcttcctgtttcctttgtcaaacatttgcattgattgacaggtattcaactgttgctttgctcctgggtgcgaagtacagtttgttcttagtgttggggtatgatgagttgtttctcattcttgtgcacatcggtatgtatgggtgtgtggtgtgtgttgtatatgtacgatgtgtgtatgtgatggtgtgtgtgtgtgtgtgtgagtgtgtgtgtgtgtgtgttgtggtctataaatgtgctggtgtgtgtgtgtgtgtgtgtgtgtgtgtgtgcgtgtttctcagtgtctgtgaatggaggggggggaatggaggtggtggtgtgtgtgcacatgtctgaatgtgtgacggtgttatgtacatgtgagtgcggtgtgtgttaggatgtgtggatgtgagtgtaggggatgtgttagggtgtagacagtgcttatgggtggggtgtgtggtgtgctcctgccaccctgttttcttggataactctcctgagccatgagatctcacaacctggccagccgttcttccctggctgcacatacagaccacagcctgcagctcatggcttgtactccaggaagacagaacaggaaaaaaagagagtgaggtggagcctctggccccttgtatctacagctcctttctccctgtcctgccaggtctcagggaaggccagtgtgtctgtctgtactcaggaaccatagctggaggttcactgtcccaaccaccacaccgtctaatagaagggaaatgggaattagcatgaacgagatttctctgaagccagtttgatgtgtcattagcatcctaaaaacaacctgtgtgagtgatgtatgcagaggaattctccagaagacagttgggacttcccttgaactagtatgagaaagccagctgctcttgcctgtcttgtgggaaaagctccttacacttccttttcttataggaagcactgggtgcctattaaatgttccaatggggtggccatgccctgatgagtccttggcaaccccgtgctccccacctggtcccgtgggcacctttaaagcactaggtggtgactttccccagttcaagaggaagaggcctgccgtcaggtcattgccagttccttctttgttcccacttcctccctgggccttggggacctgccatgtacaaggtcattttggacctccgaacccttctagctgcatactctggaagcttagcagtcacccctaggaattccacattggcatatgaacacaggctgccattggccactttggttagatttccgaggcagcttaaagagacattgggcagcaaaagaccagtctgacctcaacagatgggactgtctatttcaaaacagccagtggcagacactctgtcaagggcaagggagtgcctgcaaaggcgggaggggatgcctggagttttggggaatggagggtgaaatgtagctgctggggccgcactcaagcctggagtagtttgctcagaaaagggcatttcatctttagaggttgtctttccctggctgtcaggatgcttccaggtctacccaagctgacgagtcgatgatgtcatcattaatgggaaccccaagtcaaatgtctttgccagttgaaggattagagtttgaggacgttggcatatggtgttttttgtttcatgaagtcttggttagattccttctaatggggaacatgcatccgttcactctttaagggcttgggaacaccctcagactctcacctcatagcctttcatgtctaaaacgtcaaacagtgcactgtttttcaaagtgagtgaaagcctttatacttttctaggataaatgcttatttttctccattctgtccaccaaagccagccgcttctgggctgcttgatttctgataccttggactcggcctaacatagcagggagaggccaggaaatcaaagagacccggccatcttcccatgtgtccacatactgctggcacgcctcttccggacatggacatgactttttatggagacattttgttgtaatttcagaaggtggttgcagttttcttggctccattaacagttcgcacatctggaatgtgttcctgtgaagatgttggctggaatatgtgtcttgtggcctggagttgcctctgacagaaagacagccacagaggacagtccttgctagtgagtgggcctagcccagaaccttctgtgggaggcccgcagaggaagacccagcacagaggtcacgcagctcagcccccgtgggattatttttaaaatggcattttgtatgtttagttctgtccttactctctgccgtggcagttatagcttggaaaggatttaacaacccttgcaccagactatctgacagattctacaattattttatttggcttaaagggatttagggacatgtctcacactgaagctcctgactctgttccctgccagagagagaacagaccacggatggccatggcaaactgcggcgcagcacttgcctctggaggaccaggatttgataaatgacgccagcgtgtgccagcacttgtggtttacttgtctaccatgatgaagtagggatgactgccttagctaaaaactggccttcaaaccaagatagatttatttccactttatttgaaattatggagatattttctatagtgatgtatgcattcgtatttaggcacctgtcctggcccgcctttggagttctgacaggatttctgtgcacattcactattgttcccttttaaaagggccctgcccacctccctctctccgtccctccatccctccctccatccctccctccctccctccctctctctctctctctctctctgtctctctctctctctctctctgtctctttcctctctccctctgctcctggtcctagaggccagtctcacccctcctcttttccccttttgcaatccttttcccttaataaaaaaaccctgctcttgatttgtcacatggtgtctctctctcttgagtcgctttttaaaaattacaacagtatgtacatgctttggactgacttttctgtattcactcactatgattaacagggaaaagctagggttttgaggtagttgataattttttccctcttctcaatataaacttttcacttctgtaggaaagtttggtgtgagctcaggaaatgtacatcagtgcaaagccctgtgcttctgtgtgctcggctgtgttacacggcagggatgccattgactttgctcattgactttgtgtccgcccttagtccacactgggaactatgccgatcacagaagccacaggaagaagggtcaactactgcttcatttgacagctgagggctgaggctcagggtggtgaggtagcttgtgtgagatcccctggttaatacagcacgcagggacatttgaacctgggcactgtgggtccataggaggctcaatcgctgtcttccccattctgtgacattctgatatttgtcgggaaatgcaccgtggaccttctgagtgctgtggacccgtgaaggaggctttcttggtgactggtgcttaccagcctgttttacctgcctaagagggttttacagtgttggcaaatataatcattattttagcgtgatgtagctgttctgctctggattttaaaaatactttattcttcttaacctataagggatgctttttttaaaaaaaaagcaataatatagtgttaaaacatttttggctttatttctggcaaggtctctcactcactctgtaactcgggttcctggaactcactctgtagtgctggctggcctctccttcatgacaatcctcctgctttggcctcccatgtactaagtctatgggtctctcttcacaaatctattatttctcttcctcttcctcctgcctgcagtagaagggtgatttttttttcttggttggaattttggggaaatatattgaaggtgtgaatgacagcttcttacagaaaccgactcacaggatccagacttgactcacgacaggttctttgtggacaccaacactgactgctcaagaagagagcttgcttcaactcctatcttcctcagtccttataggcaccccagcttgtcttgtggggttatgccaaccagtgtgtgtaggagagacatgaatagtgttcatgacaggcagggcgactcttaaatcagtgttttctgggcatggtggtgcatgtggaaccccagcactctgcaggcagaggcaggaggattgcaatgagttgaaggccatactgggctctagagtgagactgtctcagaacagcagcggcagcagtaacggggtggcggtggcagcaagacgacaggcctcaggcttccaggtctctctgatgacttcagtcccagtagtgagtcccaaaactctcatggcctcacctcctgccattgagagacaaaccaaagacatgtttgtccctggttttggagaatagttcattagagagacagagatagtttcttttaagggacccttccttaaaagaaagaacagaggaagtaatgcttatttttagctaagagcatccttgggctccttgggtggttttttaaaagatctactttcaataatgtgtgtgtgtggtgtgtgtgtgtgtgtgtgagtgtgtgtgcacgtgtgtgtgtgtgtgtgtgtgtgtgtgtgtgtgtacattagtgcagttttcctctgttgtggagattctcttgtcccaccaggtcccactgcttcagccccaaatgagtatacagagacactatattaattattaaactgttagctgatggctagggcttcttattggctagctctgtcttaattattaacccataactactaatctgtgtatttctacatggtcttggcttactaagagaatgcccagacctgttactcttttctggtctacatggagactgatctctggcgggctctccacttacctttcccagaattctcctcatctcctagccccgcctatcttcctgctaaatagatttttatggactttccccatcatccctccaatgccctggagccatgaactacctgacatgaatgggtgctgggaactgaatccaggtcctttgcaagagcagccttccctctccatcgctgagcccttgggttctgtaggtctaatagaggacagcggaggtacatccatggggaagtcagctctccctccctagtctcttctaagccttggcattacttttatgtactgcagccttacatgaaaaggtgttagagggagaaaacacaagatgagaagcagtgacagtctgtgctccaagaataaaagcatcaataaaatatcattgcaaaaatgaacaattgcaggcacagagtccatgaagttctcagcgcagtaacaccgggggcattctgttgctcactgggcaagatcatgggtgtgtgtgacttgcacagcctgctggggtcagcctccctcctttaagggcttctggagcctccagagcctcacacataacagtgaaggagcccatctcactgtaaactctttaacgctgtgttggttactttactctttgatgtgatgaaatactcaacaaaagcaactcaaggttgggaaagtctgttgtgactcactctgagggtgcaggcttggtggcagggaagatatggttcacaagtgtgagtgtgagggctctagtgacaagtgacatcacatctataggcaagaagcagagggagatgaatgccttttccttttgattaattctgagaccccaatccatgagatggttctgttcccaataaggaaggtcttccttccccagtcaaacttcctggaaacactctcatgggcacacctagaggtgtgttgccatggtgaccctaagtttaatcaaattgacatccaggaagcttctacctcttcacttggaatggtgcctgaaggagtagctcccgggcagcatggagaccggagagggaagacaagccttgtccttacacaaacaggaagatgcagaaaacataccttagtttggttcaaatatagcatcaaaggcacccaggagctcccatgcaaaggtaggattcagaagccattgtcagcgagcagccggggtgacggtgttgctcttacaatgactcaatgcagagaggaaaacagattcaagagagaaggaatgttccattctgagtttcccgtgccagtgcaagacagagacaagaaatccaagggaagcaacgagaggcttaggcaagcgagctcaggggcacagcggctactgtctaacagagaaagagaagccactgcagatggagagagggagggggagggggacaggaagggggaggggatagaccaacatcaggacccaggggcaagcccctaggttctaggagtcagatgtcacagcactggagaggatcctgtgagatttggaggggcgggacatatggaaaacactagggaatcgtggagcaggcacctggacatgcctggggtttatagacacaagagtgcatccctgcttgaggcctgtgaactgtgtctcaggtttcttccctgaaatatggggtaccacctcaggagcagggctagtgtcagcagctgcaggcaggagagcaagtatatttaccttttcaagtaatttccagttagcatagactataatggctttcctaggacattttatatgcatttattgttctactttgttcgtagcccccaccctcctctctacacgtccctgctgccccctctcacaggtcctcccacccgctaatagcccctcatctattttcatatgtgcacgtatgtgcacgcgtgtatatgtataatagatgtatgtatttgattctggattccctatgtgagagaaacatggtattttgtttttctcctcccccttccctatttgtacccctcgtctccttttcctcctcctccttgttttaaagtgtggaagacaggattttaaaaagtccatttatgaagacatatactgtcctttgcctgctgtctgtatagaacccagccatagagtccactttattttgtcaagtttaatgttctgagcacgagctgtattcccagctctgaggcttcagccttcagtccttagggtgtctgttatcttctctgggcactatattctcagcactagaacccccagcttttcccattgagcaaactcacgtttattacactgatttaatgtgtgtgtgtatgtttggggggtcatgttcacgacacagcacatgtgtgtaggagttggttctttccttctactgtgttcgtgcgtcccagggattaagctcaggttgtcagacttggctcaagagcttccacccactaagtcatctccctggctctaaatataaatgtgtacatacacacatacatatatacatacatgcatgcattcatacatgtataactggcttatgttatttatttgttgtgtgtgtgtgcatgtgcataccacagcatgcacgtagaagtcagaagacaactttcaggagtcaggtcaggtttccccttctacagagtgcatcccagggtttgaactcgtgtcttcagactagacagaaagttccctcacccactgagccagctctacggctctccagtcagcatgtgttaattgtgtacagcttgttgacttctgggatgaggggacctcatgatcactcacttcatgattataaaattgattaccgttactgggacctttgcagttttccctcggaaaatactgatctggcgtcaaattattttttttcacgtttttgcttcagatacatttgcatttagctgtcagccttctttacttgtatttttaaaaatgatgacagctctccttttccagggtagcatactccggaaaatcctcttgaaccgctacttcaaaggtgaccatggcgttggtgccaatggacctctgtcaggggcctatgccaagacagcacaagtgggaggtacgtgttcttccacccattttagggtctcacggcattatcttcatggcagtgctgctccgctatcttagttaaatgatccaagtgtaaaatattcacgtaaaacacgagtgaaatgtttgtgtagttggggttcatgaatccatccataggttgagcattatcgtggattttgtctttgattctgggtggtttcctcacaatttcttcatgcacgtattaaagacaaaatttgtagaatatttttatagagatttatttatttttatcttatacatatgtatgagtgcctgccatgtgtgtctgcacaccacatgtgtgcctggtgaccattggagtcccttgaattggaattacaaatggttgtgagccaccaagtggtgctggaatcaaacccaggtcccctgcaagagcaaccagtgctcttaaccaccgagccacctctgcagctctttctagagtacttaaaggaatgacagttggtgacattgaattgcatattggatgtttaagagttccatctttgtagattttttatatttgtaactaaactctcctgtggctcatgttgttatggtttaagaatttgaaaacactgtttgctgctaaaaacaatgtctgtgctgaagttcgagttgctgttctgtgtttctcttccccgaccacaggaggcttctctggacaggactcggacaagatggggatttccatgtctgacatccagtgtctgctggacaaagaaggagcatccgaacttgtcatcgatgtcatagtgaacaccaaaaatgacaggattttctccgaaggcattttgcttggcatcgccttgctggaaggaggaaacacacagacccaggtgctcgtctgttgctagtgctgttcgggttgtgatttctatatatttttaaagaatacttttgtttttgagaatttcatacaatgttcacatctcctgtttccactcctctctctaactcttcactatccactccgccccccaaccccccctaactttgtgtcttctccccctgccaaaccagtaaactttggatgacagtttgtgctgctcagataccctgtgtgccgagccgtcttctggagcttggttaacctatcaggagccaccccttaaagaaaactaactctcctgccccagcagccagatcacacccacagatcccagccagggttgagggcacacaaccttcccacccaatgctggaacactcactggcttggccgcgtgcggacagccacaaccgctgtgagctcatgggtgctgtggtcctgtttttgctctggtcctccctgacctccaactcctatagtctttcctgtttcttgatcactggttaaaggaaccagggaaacgtatccttttagcttccccttgctggctcaaacaaaatgaaagaactcacaaatcacatttcccttataaatttatgtgatttgctattgaaatgatagggcttcccccttgctctaatcagaacatcgtttgaagctcattctgcatcaggagccactccacagtggcagagggctctgtgtcacgcactctacggtggcagtgggcgctgtgtcacatgctctacagtggtggtaggtgctgtgtatgtgcgtaccaaggacatgacactgtccagctgcactcctgtcccttggcgacccctgccaggttctgcttggctcctttgcacccaacagtgtgctgcacgagcccgggctctggaaacttcccagggagcacttctgaacttcctggctcactgaccttcctatatcttcctaagccatgaagcaatgcatagccccagatggctagaaatccccaaacctattggccccaggagcggcaggcagaagcccagtcagattcaaaactggggtattttgctttaatttgttaccggtacatttaacaacaggagcttttctgtatgagagaccggtttgatagcagggctttggggacaaaggctgaagagacagcaaaaaaggcagcagtgtagcaccggtgtgaactggcttgaactggcatctctagcaacagtcacccagctgcactttctacatttccctgggctgcagagggtcatcccaggggaacgctcttcatcctcacatgggtgccgatggtgcgggctagctccaggagaactccaggctccacttattaaatgccagagcgttgctcccgagatccagtcttcagtcttcatttgccttatgtttctgtagtcctgatcactgggaaattgtttgttctgtaacctttactacctggaccctgcaactccccctggccgctgcccccagcttctcttccagcctcgtgtgactggcaccgtgccttctggttgtcacttttgactgactggtcaccctgtctccttgttggtcatcccttgatgacaaacctgggtgattctgcccttctgatatcgcttctatccctaactcttcaatccctgcttctcaagccatcgtcacaactccttaccgttcgctccacggggaccaagtttcccagcttcctttttgccttccctctaacgttcttttcgttgcctccagtgacattttttaataacactatgttatacccctgcttcagatctctcttcccaggaaagtcagactccctgctgaactcatgggattcttcctgatgcaggtccctcatatgctcaggctatctgtcattctgtctgtcccgtcagtgcttctctcagaatcgctttcaggcccttgtctcactgggcagagctgactgccagttactgcatgaccttgctgtgacttcctggtgctttgggtagtgtttctatcatgtcacagcacctctccaggtgtccccagattccattcctgaaggtttggaacacatcttcattgctttgctgtttgtgtttggagcgctaatgcccagtaactattcagtggtggatatgctgatgagaaattggttgtgatgaagccttctcttctagctgggcaagtggcagctgctccctggcgagcctcactgcacttgtttctcacttggagccctctctgtgttcctttattttattgtctgtcttacattatgtctctccagttaattttctaatatttgtagagggttatagcctactttttattttcatagtcttttatagctgttcaatacatatcacctccctaaaccatacaccacacacacacacacacacacaaacacacacgaacatacacacacacacgtacagacacatacacacacatgaacacacacatacacacacacacacacacaccaccaccaccaccaccacacacacacacacacacacaccaacaccaccacaaccagacacacccacacacacacacacacacacacacacacacactggctggtgatacaaatctgtaatcccaactgctcaggaggctgagtccagaggaccacaagttcaagggaaacctgagctaaggagcaagctcaaggctggtctggtgaacttagtgaaagcaggtcttaagcttaaaagtaaaaggagagctgggcctgtagctcagtagtaagcatgtgtgtagcatttccgaggccatggcttcaatctaaagaaaaagaaaacaaaagtcacacagaactgttgaagaaacaccattaattcaagtctgtgcatgaaaatccccttgttgcttaaggaaacctgactctgtaggttctgctgcttaggtctctgatttagggacctcatgatgtcatcagaatgtccctagatgtcagctgtatgccgtggctttaagaggtctagatcagacctgctgaatctacctctcccctttagtgactcagatgtgtccccactatgttagttactatttgttgctgggataaagcaccacgacaaagcagctcatagaaggaaaaacttgctttgcttatggctcccaagggtcagttcacaataattagagaggcctggcagcaggtggctggagcaggagggggagaggtcacatctccgtccacacaaaggaagcagagagaggaacctggcagtgtggtggggctggagaccctcaaagtccctcgacctcattgacatactctctctagaaaggcttcaaattctaaaagttccataaccttaccaacagtgtcgctggctggggaccacgcgtgcaaacgcacacgctcatggggcattctcattctcaccactcactcccccagacttctccagttccacagggattttacatttttttttaaaaaagattcatgtgtatgttgagtgcccgaatgtatgtaagtgcaccacgtatgtgcagtgcctgtggaggccagaagaggaacttggatcccatgaagctggagttacagatggttgcgagattccatgtgcgtgctgacaactgaactcggggtcctctataagagcaacaaatgctcctaaccactgagccatccctccagccccgaatttaatattcttaatttcctttagtcactagtgtttcacttaacagtttgtggactgtctgagctgcccagcccccccccccccaggtattctagaccagagagaatccctggtccctttctacacaagtcacttcctgcgcccaatatgctccatcagatgcggggtggtggaggcagatagaagaaattacaacttcagacactaataataagagaaataaaagctaggcattatgggtcactccatacccagaggatgagccagaaggatcacttgaggctgccctgggctgttgagtaaggccttgttagaaatagaaataaaatataatatacaggctattgagtattacataacatgtggcaaatccctctgcttcacagcatctcatttttttaatcaataccatgtgcccggaatgagaagaccgtactcatcacaggggctgacagtgtcctcgagagggtgggtgtgagtggggccctgacagctttgtcctcacagagctgtggcattgccatgactttgcgactttcctactaacgttttacaccctcccttcccccttccagccagactgcgttacaaagattagagctcaagcatcagcttaattcgtgggaccataaaggtctgtggatgctgcatttatcctgcaagccatcagaaccagcttgactgtctcagtgtcgttgccatggttacagtggggctttctttttcttttcttttcttttttcttttttcttttttttttggcctgctcctgtagagttgctagctctctgcttaggagcatcccctaacagacatgaagctgatgcttgaaggctgtgtaaaactcactgtgtgtagatgctgcacgtgtaacctagactttagagttctgtctagggtagggcctggctccgctccggccattcctgtaggaaaacatgtgcacagctgtcagaccccaccaacctgcctctttagattttatttgggggtgtggctggttccacttgctcaggggtgtctcctctggactgcatcccctcctccatctcctgtcaagtcttacgaatccttccataaagttaccaagcacacggtgacgagtaaccgcagctcagtatttccctctccgggaaggtacctcttgccacgcttttggtcttaaatcctccctgaatcattaatgataaactggagtttgttttcagtcaattttccctaaactacacgtagagcatcattgcttaagaagtagctaagcaacttaaaacctatttaccagtgggtgcccgtgagtgaagttgttatggtaacgcatcctaaattaaatgtactatcaagaaaaataactttgtcacctaacagggagcccttatttgtccggggtagtcataagtgagtgatcatgtttcactttggattacaaactcatgtgggtaggagtcttgccatttttttctttttgttttgtctgtagcaaaaatataggaccctacacatagtaggctttcaataaatgtgtgttgaatcaatgcacagctttagatgacaacttactagactcataattaaaacatacattcaggaggatatatcaaatagaatataaaaggttagaatttagtgggaggtgctaagtaaaactggctgttattaatataatgacatgtgctattagtgtgtattaagtggaatgagacactgacagcctgtccatttgtagaataaataaaaggtagcacactgtgctttttatctgtcaggcacgtgtttatttcagagtaaaccactatttctcttgcctcagggattgatactttaaactatgctttctctgcagtattctttctaccagcagttgcatgaacaaaagaagtcagaaaaattcttcaaagtcctttatgaccggatgaaggccgctcagaaagagatcagatccacggtgactgtcaacaccatagacttagggagcaagaagagagacgatgacaatgacctcgtggcctcaggccctcggatgagaggtgaggagcttcctgaatacctgggagaagaaagcaaggaagcatttaaatctcatgtagctttgtcatcttgcttctggggtttaattattcccagtgtttccagtgtggacttccagcggtaaaggattttggttaagggcttgaccctagactagctctgcaggaccaaactaaaatggagtttaattggtgtggaagcaatgggcaacatgaaagacgtttgatttccttgttctgttcagtaagaaaaccatcccaaactttctgggaatggaaattaaactctgaggacagaaagtgtttgcgtttgatataaccagatgattgccagctaaatacaatttgtggaggtgttaatattttgcaaatgatcattctctcctatgagatctataggaattcttaggtgtgtgcacacacatgtgtttctttatacattcttgttctttctgtgtgtgccacatgtgtgtatgggtgtccacagagaccagaagagggtgtgggatcctagaaactggatctatagaaggctaggagcagcctgacatgggtgctgggaactgaacccagtcctctggtcgagcagcaagggctcttacctgctaagctatctgtccttttttttgttgttgttgttttgtttttgttttttgttttaacttgacacatagctagacataactgggaagaggggatactttccttccttccttccttccttccttccttccttccttccttcctttggaggggggggtttcaagacagggtttctctgtgtagctttggagctatcatgacactcgctctagagaccaggctggcgttggactcacagagatccgcctgcctctgcctcacgagtgctgggattaaaggcatgtgccaccaatgccctgcagaagagggaatcttaattgaggaaatgcctccataagaatgacctgtaggggagtctgtggggcattttctggattaatggttgatgttggagggatcagcccactgtggatagtgccttcctgggttctgggttctataataaagcaggctgagcaaaccagtaagcactccatgacctctgcttcagttcctgtgtgtgtgtgtgtgtgtgtgtgtgtgtgaaatcttgtgatatatctatcacaatatgaaataaaccctttcctccccagcttgcttttggtcagggtgtttaagcacagccatagaaaagcaactaacacaccacctgtccagccctttggttatgtccttgtgaagtcatctgtatgtgtttttacacattcttatgtgtctttgtgatatagatttatgagtcagaaaattctaaaattgattaaatataaagagcttttcttcagattgctgtattaactttttagctgttgtgtcccccccaggaaaccgttaaacatcttgttagataattttaaaattcagctgtgggaaaatttggattcttattgtggggtagttaaaaaaaattagttcaaaatccagctacttcttgcttttcagtgagagatccatcacttcacctgaaagagggaatgaagggacagctaacagaggcctcctcagccacctccaaagcctactgtgtgtacagacgagagatggacccagagatagacatgatgtgcccaggcccagaagcggggagtgcagaggaaaagtctgccgaggaaattaccatgagcccagccatcaccgtcatgcagcccatcctcaggttcctgcagttactgtgtgagaatcacaaccgggagctacaggtgagtcctcttctctctgtgggtgagctctgtagcctgtgactgtgagtcatccaagggaatttaggagaggattctggagaaataatcaacaaagacaccagtgccctgttgaaatggtaaggaagaaaaaataagagtcaaaatgtttaggcattaaaaaacaagcaaatgtacacatcctatagcaccactgagccccttccctctcctctgcagtgtttgttcaggacggccatctttgtctgcagttcatggttttagactcgggtgtttacattgttcccaatccgtagttgttggcacaatattgaatatattttacgtttcattagaaacaaagtcatataaagcattactatgatagtgaaaattgctttgctaattaatgcagcccacatccataacatctccacccaccactgccatttcctctgtcagacggggtgggtggacgagggctgctccaggctttgactacctccctggcgttatgtgtatgcatgacgttgcccatggtgccatagcagaggcacacgaaaggagctatcttgactggcctgactgagggagattgagaatgctcacctgaagagcttccatttggcagactgcttccaagaaagacacagggccaccacgccagcccgctttgccatgctgcaagctagtgtagctggcaaatgatctttattaatgaattgcagagaactggctgagatttctgcagtaggttccgcctaggatctcctaccttgtaatgtcactaagcaatctggttctcagagcatctgtccacacagagagaggcagagtgaggagatgtgttcactgttgtctagaacgcagaggatccgaaaggcaagacaaagtgctgtccgtggcgatgagatgctctggaatgcatgaggagcgagcgtggctcatgtggaccagcctgccaccgcttaggtcaagcttctgcagtgtgtgctgcctgcttgctcagtgcaacctacgggccctgccaatgtgggtcacagacggcagagcagatgatgtcatatctgactgtgccactcacagaagctggttcagataatgtataaggctactttgatactaagaacaaatagttaaagcaaattcaaatagatatctgtaagtacattaaaatacaagatcccctctcttccccattctttctcttctttagcgtattccccaaagtgcactaataacactgttttcttccagaaaatcctatgtacaaacggtgatctttgcatgtaaacctaagtagtctcgactgtttaatttagtaacttcatgtactgccacactgcttatttcttggtggtgcccatccatacatatggaagtgcttcctaagatcccaaaaccatcacgctgccagggataaggccatggcgcctaacagacagtgagcagtgaggatcttttgtgtatatctacacagatttaggatcatccacacaagtgggactcttccctgagaagcctagtagggcttcatgtttcccataccacggcctgacggaccctgcacagcgaagacacggttgtcagggacggttcgtttggaagttagaccccctcccccagattttgttctccttttcctttctacttttcacactcccttccaccctctgtaggcttaaaatgatggcagtggagcagcgtttactatgacctgttctgaaggtgcttacactacaacctgagggcctctcttaagagaaacttaacttagcgtatcgatatttaaatattacttagttttcaaattagcttggaaaataatgagtctgtttttcaaattttatttatttattttacatcccaactgtggattcccctgcttcctcttctcccagtcccctccccccaacctccgctctgcctcctcccctctgaaaaacaaggagttttattatgacagtctcatccctatcgtttgcttagacatagtcacaccagtatgtcccctgattgctccccttttgtgttggtccccccactttccccaaggtgttccaatttcttgtgaagaccaattgaattccatactggcaagaatctttttgagtaacacacacacacacacacacacacacacacacacacacacacacacagagagagagagagagagagagagagagagagagagagagcatggccagcacccctttttctgtgttttgctttccgtctctcagttgcactttctttcatccccccccagaacttcttgaggaatcagaacaacaaaacaaactacaatcttgtgtgtgagacgctgcagtttctggactgcatttgtggaagcaccacaggcggcctgggcctgctggggctctacatcaatgagaagaatgtagcgttggtgaaccagaccctggagagcttgacggagtactgccagggcccgtgccatgaaaaccaggtaaccatgactgcagagcttcatgagacgtgagtcacggtgtgccaggctaggcatagagccagcgttgtgtaccttcgaagccttcctgctcactctgccaggcattgccacttctcttacaaaacatacaaaggtggaattgtagactagcaaatgttaggccacattttaaatttcatcatgaaagaagattcccgtgaaaatatttaagatgaaagacttatcaaaagaagggcaagattgtatttcctcccagtgttcagtttctctctgtagggaatctctccagatgtgtggaattaactcactgtggctttggctctactgcagtgtgggaggaatctaatacccatgttacacactcattgagctagtcaaatacccgtgtcacacaccaggtgagctagtctaatactcatgctacacgctcattgagctagactaataccagtgttacacactcaatgaactagtctaatacccatgttagacactcattgagctagactaatacccgtgttacacactcaatgaactagtctaatacccatgttacacacttggtgagctagtctaatacctgtgttacacaccaggtaagctagtctaatacccatgttacacgcttggcgagcatatcaagtgggtctcgctactgtccttcagtcagtggcttctgacccagagctcacctgactttgcagtgtctcagagtgctgccttcagcgagctgcagaaaaaaaagctgcagagtactttctgagcccctttgatgctatatatgcatgtgtgagagacccaatgttcacctccagctcccagagtaccttgctccacttgaaggacacgttatgggagaagacagaacatataagggaataaaggggatgatgtcattttgacagctttttagcatctatgaagcatcttggagcctccaacacaggcaaggtttagggcggagtctccatgtcaatcatttctagacataaactttaaagttgcgattgacactaaacatcagtggttggtgtagaaaggaaaagttcagcttttctattgtagattatatgactttcctcacacatactatgtctgtgtgtacacatatgtctgaacacacacacaatatgtatacatccatgggttcatatggtggaaacacgtcgatcatgtaaggttattacttccttctctgtaatgtgtttatgacactaaaaggattttcagatctttccccctaattttcaagattatattttagtttcctacaacaatgacaaagacatccttggctgctgattcaaagtcaatgcacagtacagaaattcagagtttggtcttgttgataaaattctctctattgtagaaaatgttacacacacacacacacacacacacacacacacacacacccacactagtttcccattttgtgaaaagtctgactgagcattccttactttgtggttaacaatgaaattaggttttgaaattccttaatgaaaccaagtaagttctcagtaaaaatgtataataaaataacaagtcctacctggataatcccccatgctctgaaaatgtgtggaaggtccatttggctggtgttcccatgagcagaagcctcaggacataatgtcagtgttggatgggaatagctttcctctgcacaaatgcccaggccaagctgtcctattggctggggctgtcctttcttgtgtgacgcactggggtgtcagtttctcaagctgctcatgtggcttagaagtcctcatgctgcttccatagaacgaagcttgaaatcctcacacagtggcttttcaccctcagagcacacacagcactctctgcgcgggtgtttttctactttgttcaaccacattccctccacaaatatgcaagtccaaggaccctgtgaactttcccaccacccaggacacgaagtcacatctgctccgagttttgtgaaattcatctacaatcccatttttcttgtcctcttatatttattgcaccttaaaattcacagttccagaatctcattttgcattagtgactgggggagttttaagttacccagtcctctttggaattctgcagttctttgtgtcaaagataagtgtctttcgcaatgtgttagtattttgtgcccagtaccagtcaattgatagaccccactcccccccaaaaaaactaatcaaaatgtccaacattgtctgtacctggtatttgaaagtttcaagtcttctgtgaccacgtctagtgctgtgtcaaaatagcatgccgttttacagatatctccttttctagacctgtatcgccactcacgagtcaaatggcattgacatcatcatcgccttgattctgaatgacatcaaccctcttggcaaatacagaatggacctggtgctacagctgaaggtagtgtgaccccaacattttccgtgtgcctctcctgcttggagtggattttaaatcttcaagtgattgtgcaaaacaccgtctcacccagactcttcaagtgatgattgtgcaaaacccttttcaacccaggaactgacaggagaggacagtgagcccaccaggcgctcactgagccagggaaagcatgattcacctgcaggccatagtcattgtgaggttctgtggtagagatgttgaggctgcccctcacctcttctcccctgttttaacttcctgtttttcattacaaacagaagtgaaaggtgttggagatgcactgtgacatgggctttctaatcttccctggcttgagaattccatctagtggtcacaattcactaacataaaggaatgttgcattttagtttaaggtctttcttccttcttactgtgttatattaggatctagctgcctcccaatgacagtgttagtcttgagcctggtgtatgcttccagaaaatcctacctatcaaaatttaggcatataagggcaatcaaatattttttgttcaaacgaaaagagataaatagatgaaaaccacaacaacgtacataaatcttacatgctaagaaataatactcaagttagataagttacttgaggccacattattgtgttgagtgtttacgatggtgtaaagcaaatgcagggactaaggaaatagcttggtaagcacagcactcaagtttgctcccccagaaaccatctggaaaagccaagtgtggggataggccttctaagcctagcgctgaagaggagcacctctggcctgacaacatagcccctaatcagtgagctgccggccattgagagaccctacctcacacggcaaggtagagggcatacttaagatatgactgaggctgtcctctggccttcacatgcacagcacatgcaaacaaaactcttcacatagttaaacataacttttttttttgtaaagttaagcctatccaacttgatagaaaattaggttgaactttgtgcaggtgagtggccgaggagaatctaaaatgctatttgtatgtgctgggttatatccaactccacttctgggaatagtgtgctgggttctatttgtgtttttaccgcttttatccattattgatgtttacaaagtggagtcagagacaggttgataaatggtagtttattgggggaaaaacactcacgaaagggagccagtgaccaggtttgcacctgagcaagatggatccagaaatgcttcccagtcagctcagccaggcgaaagagagccgcgtgcgagcctccctccttcttaaacccttgttgggcatggtcagcagtaactcttaatcagggtttctccctacaatccatactgtgtataagatctaaccccccccccccctcccctctctctctctcacacacacacacacacacacacacacacacacacacacacacacacacacacaccccgctgcccttcttgtgcctttgcttcggtttgtgagcatctagtgtgtgtgacaggcaacccaactggaagcactaaaaagagtttgtcattctctcttaaattcaactttagccataattcctgaagactcaacatccagaggcctcctcctttgcctctaaagttctttgtttgtttaaaggctgtattttaaaatctggcttgtcaatcacagggctctgtaagggagatggtgaatgactcataaacttaacacagcttatgggcatgcaggttacttataaaggcagatcttactttgaaaaattaaataatgatttaatgaatcaaaatactaggtgttctagttaaattactttaaagtggatcatttaatttttatttatttcagtagcacaatttattcaagcatacagcagtcagctacattaggctgcacctaaagcaacacatgtgtttgtttctcttgaaatactttaaatatggttttatacttaaggactaagatgagtgtactttttaaatctaaagattttgttttattattattgcctggtaagagaacacctgtaaggcagaattatatatgttggctagtttaggaaagttcatgagatgaggcactataaataattatttagtaacattgactcctggatctgatggcttaattatccataattttagtaatataccttcaataaaagataacgctatgaatatataccatatgacataatataatttaaatataatatcatacaaattacagttttaaatatgctttatatattcatttaatgtatggcttaatgaatttctcagatgcctgtctcgtccttcactttgtattttgttttcgtaactggtctgtgaatgcaaagtgctgcatttgctaagaggtgatgtctgtgttttgcttagaaacactccagcttccattggaaggaaaatcccgctaacaggagtatgtctgttgggtttttcagtatatccaggctcatgtacttccagatcggttcagatttcaggatgttatttgcaagatttctttctaatctcaccaagtacgaaatttgattgaaagcaccacactgccaatggtgttggggaactggatacattttaaagtcctttctcactggccctgcagagagtggctcatctgagaacaggccccaagatgctgaggtataacctcggaattctgacagctctgctcatgtgggactaaggacccgtcatccgctctaatccctaaaccatatttttttaaacatttgttttttggaacctagattataaaagtggattgtaggatttgaaaatatttgtaaaatacaaatatgggacagaaaaaaaaagtagaatccctctcgctgcactgaaatcctttgtggtggctgtggcattggtgtgacccgacgtcacccttattatcctcagaatcattagatatccctttaaaggtggcatctggaagttctgggagcattggacagaatgtaggaccaagtttaacaagagttaatttacacgatcttatcaattagtgctttatcctcctacaccaaacatggattcagctcaattatttcattctaaaaccatgagaactccgagtctcttagacatgtctttaacaccccacacataacacacacacacacacacacacacacacacacacacatacacacacacacactcgtacacacacatacatgcacacacatgcacacaacatacatacacacacatgtacacacatacatacacacatgtacacacatacacacacatacatacacacatgtacaacatacatacacactcacacacacatacacacacatacataaacatacactcacacacacatacacacatacatacacacatgtacacacacacatgcatacacatacatacatacagacacacagacacatcagacagagtaaggttttatctcaatgaggacagagcacttccagtggtgactctctggtacccgttcagcattgaaaattgcctcttactttgatatcttaagcaacagtgtttgaggtagtgtgtttaaaaacaaaattgtaacagctgaaacatacactgctttaattctatattaagagaatagtagacaatgtcactcagcatgtggtgaggtaaacgagctatcaggaaatgacctttatatttctaactcaggaacttacaacttttctcactggtggttcacaaatttatgtaaaatttcaatattagagtaacattattacttcatttaaaaagtggttgtactgaattctttatatgtataccatgtccataaaatatcactgattcctgtttctctgttgtgttaaagtgtcatcatagaaatccaatttaaaaaacattggaagaaaatatatttctatttaatgtagtatctagtcagtcttccatttaaaacacctgtaattttaaaatatccccccttgggagggcagtggtggcgcacacctttaatcccagcacttgggaggcagaggcaggtggatctgtgagtagaggccagcctggtctacagagtgaattccaggacagccaggactgttacacagggaaaccctgtctcagaaaaaaaaatccttataaaataacccccattttcatgacttgttgcttttattttgtattgataatgaataaaatattctattgtccgttagttagacaaaataaataagaagtttcaaatttcacctggttgagaaaacacaaagggtgccagtgagctaagttaacacagatgccagggattgttaatctgtggtgtggactttgcgcatgtactgaccctgtccttgtccccagaacaacgcctccaagcttttgctggctattatggagagcagacatgacagcgagaacgcagagaggattctcttcaacatgagacctagggagctggtaagaacacttgcccaggctgtctgttaggggcagcatctctcgctgctccagcagggctgtcaggagcaccatggcctaaattcagggagggtggtgaaggaccatgtgactcaggcttgtggactcaccaggttttattttagaattagttttctctttttatttatgtgtatgtgtgtccatgcatatgtatgtcacatgtgttctggtgcccttagaggctctaaaagtgtgtcagaacacctggagccaaagttacaggctgttgtacatgcctggacatgggtactgggaatggacttgggttcctctgcaagagcaggaagcacacttaaccctgagccattgctccagcctgattttgccagttttatcgactttaagcacttctctttgctaaatttccacacactacttaactatatacaaatgccttttgcaaaaaaagaaaagttatcttggcttaatgatttctgggtatagttgtctgtagtagtgggctcagccctatagagtcacaattgtggactggaagagtttttaaaaagcacactgcaccgacacttatggactcttaccctgttttctcccatcggtgcaatgattcacatgtttgcatcatgttgcatgtcataagccacctggagatgatttttgagtatgcaggagggtgcaaataggtgcgtggttttcatgcaagttgctccagtttatagtgttacttgagtatccccaggtcttggaatcctcaggaggtactgaagccgggtccccagaacacccaggaatgatggtttgtaaggaaggtctgaagactgtgtttaccacacccccgagttttgtttgtacatttccaaaaacacagataaattcgtttgcgtgttttgtgtatcattctcatgaatgaactgtcacagaacatctggcctcagagaaagagggagacacaatcaggactccacaagcacaagttaaaagctccatttcttttgccttctggcacacaaacaatgatgtcatccgggcatgcttcaaaagcaatgggttccagatacccgagagagcaggctcaagacatactgctcagtgtgcccgccctcccgccagtgacaaagtcctgtcatgtcagtgatgctgctggtgctgtggagactgcaagggaggctggtgccacactctctgggctcactggtgaagagtagagtggagatggagagagaagacattctttagttagagcctcgtctctccaggcagtagagtaagactaggaattgcactctggttaaggggcatatggctatgaatttatttgacagagcactgtgcactcactttgaaaagagtcccctctgccattttaacccttttctgtcatctccatgatccaccctcaagctgagttaggtgcctgccggagacctgtcatacaacagtgcacgcccttgggcagaggcactctccttgtccacgcaggttcttcagtgcccagcactggtgccagcaccctgtccccagctccctcttgagtgctcagtaaacagtggatatttctcagggttccagactctcttaaatcgtggagacttcagcgtgctagtgttcacagacagaagcagaagtgttggctataaacagggaacattgccacagtgtgattccatgttcacttaaatacgccgtaaacagggaacacagtgattccatgttcacttaaatagctgtggttttcaaaaaatattttaaaaattattttctgttggtagatattattagttcttattatggcgctttggcacaaataagttgagctagttggatttctcccactgtgataaagcagcatgaccaaaggcaacttggggaggaaagggcttatttggcttgcactgctggctaatgccctggctcacattcatttacacagcctcgggcagacctgcttagggatgttaccagccacagtgggccggggcctcccacatcaattccaatgaagaaaatgctctgtaggccaatcttagggaggcacattcccgattgaaactccctcaggtagctctgggctgtgtccagtcgacagtggaagccactacacttctttctttttggtccccgtcacgtggtctatcccgtctccccttcgccggttccccctttcaccctatatacctgccgattttatttcatgcgtactccattgccctgtctcagcactctcccttcccttctgtctctttctgtcttctcacagtgccctctacattcacacccgacagactggcacatgcacacagttcagtctagagtctgcagagaagagaaaaatgcagtatttgcttatttagagctgctttatttttggctgtcatgaagcttcccagttttaagttatagctcacaaacaatatgaagtgttgctgccaccttccagaccctttctcaagatttacttatttattatttattgctaggtggatgtgatgaagaacgcctataaccaaggactggagtgtgaccacggggacgaggaaggaggggatgacggggtttctcccaaggacgttggacacaacatctacattctggcccaccaggtaccacattcttatcagcaagtatcttgcttacctggtcatggtgtctcatgcagatgccttattattgtatttctaccttctggtgtccttatttattcagcacccaccctccttgctttcagtcagagaaaacagtaagttggcagaatgccccattgtgcaattcagggtccgctagggagccattgacaagaagaagaggcttgggagaaaacttctgtgcctggaagaagtaagcctctcacaccagagcctcgagagagggaagacaggcttctgaggaggcagggtgtgaagaggtgggttagcggtattctataacttagccagggctagcccagagagagctctgcgttcagtcatattgacaaacttttaatagaagtcattaggcttgcacctctcagtcctccccactggactcccggaatttataagttaagtcctaaatttcttcagagtggtgtttccgtttcattgctggtaagtattgataagcattgcttggtaagcccaattccacaaacatggttgattttgaacttgcatcatctaacacagacaggtttaaaatgtaaaattctaaatgtgcacacagtgacttgatttttgttgccaatggctccatcattttgagaggataaagttcaggctttgaaaatgtctcaagcctctcctgtctgttttcctacccatcttatctgttgatgaaatagatactgattgatggaggtcagattgtgaaggttgctctttggacatttcctgtgccctccaccttcagatgttcacctaatggacataaacttgaataatgttttttacatcttcaaggaaggaatccaggtctaagagccccaccacaggactgttgctcttttgtgatatagtcaatacctagacatatgcaagattttcatagtctgtccattcacagcgtgagggcagccgagttacagctgtggagacagaaaggcattttaggccttgaggaaccaaaagccaagccaagagacaagtagaaggaagtgagaaggcggagattcaggatgtgggaaagtcccatttcagagaaagaaaagtcaggcgacagagctgattcaagctaggggaaaaaaaagaagagtagaaaatgaacttgaatgtgaacagaaagaaataacccttaggctgagaattaaaattgcaagccatgccacaggaacacagtgacacagttagtgtgtctggggcagagggttgcctcggagtctgtaacaccttggtgcggggaggcagtgaaggttggggcagagcgagcagcattggtgttttctaagaggagtcgagcccacctgcacactcttcactggaagctggtcttcccctctcggcgaaggctgtccctcagcatgggcgagcagctgcatgcttcaggcctggccttgtacatacgccacgggacatgaaccccacagtcaggctaaaccaacacaattgcaggcgttggatccaaatcaacccccgtacccttgaagtctcgagacaccagcaggagagtggacagccaaacgttgaagtcaagactcacgtttagctcagcaccgttttagtaggttgagcataggagtagaaaatgcagatgctagaggtggccgtggagtgaaggaaggagaacacacagctagagcagaagcagagaaggcagactgagggcaggggaatgaagaccctgtgaggggcactgagtgtggtgcatttgagctgagaacaaatacgttcttagagagaaacaatgtgttcaaagacgaaagagcaggaattcaagccacccaggggtcaccaggggtcaaaaacaacttgctgagaggaagggggagagcagcagattcggaaatggctggggtcccgtagacggctcttaccaaacttcctccagacaagactttggaaaagcagaacagcagaacagcaaggatatgctgtgtagctgcaaaagggaagctaggcttccagagtgaaggaccaggctcagaaagggagcaagtgggctctggactgctggactcattggccttgtgatttatccaaacaggtccctcttagaatcagagatgctgtaggagcagactcgagactcacagaggcacagacatacagaacccttcagtggttctgctggtgtgtgtaactcgtcttgttcccttcagtgatacaaggtgtcattccctcgtcagcatgtgtggtttccttccggaattaattataccactcgttttccttgagatgttagcaattttcacccacattggtctcttttgactcttccatgtgtgggtcctatggctagctttcggctggagtgttatttggtttctcggccagctgtgttccttgtgaacctactgtgcaaacagcccctgcacagaggtacacatgaaatgcgtacaagatggccagctgttccctggaggggaccagtagctgtgcagtacggtgccagatccaggtctgaggtcacctgcggtgggagtgaggcactcaggcagctgatgaccttgcagattctgagtctgcccctgcacagcccagtcattcaagaaccgagctgcagctccctcctcctgactttactacaatcgtcctctgcgcagacagtttattttggtgcccgcagactttcagtttttgttgttagtgcttctcgtggcagggacaaggttctgcttttccaccgtgacatccctctgggcccttcctgtggtcagggttacaagaagccaacagtgcttcttgtaattgtcttgtctaatctacataaaactattaatacatcacgaagggaaatttcttcagctctgatttctgcggtgttgtgctgtgaatttccttgccactcagcagtgcttcctggctctgccctccccatctccaggtcgcctctgctccccatcccttctctgtcagggcttctcttgaagcagtcaccacccaccgtctggtacatttcccacccctccgtagaagctcgtcacgtgtgaagctacatcacctctttagctctatcaaacaattcatcttcttgtcgtctgagtctcttcttttgactctcacctgaagtcaaatgtttatggaaagggcagggcatctcggctcgtgcctttataatccctaatctcaggaggctgaggcaggaggactgctgtgagttccaggccagcctaggtgcttgcatgagacccccgtctgaaaacacaaaataacagaaagagatacaagaaataaatggataaatgttagaggctttgtgggcaagaagatgctttaaatagtaaatcaatggaaagtaacaacagtcactttaattcgttacatgaaaatcttctcaaaatgcaagctttaaactttttttcatgagcattttcctgaatcaatacatggcctttgaacatgtcattttaatgactgcataattagacatcatttgaatgttctgtaatttacttaatcactccatattgttaagtaattaggtttctaatatatttgatattacaaattatgctgtgattaacaccctcatacattaatctttgtccaccatgctgatggttttcctagggtaattttcaagaagtttaattactgggtcataggaactactctatacctcttgatatacattgcaaaattactttccacagtgcgtgatggttcttatgctgttgaaccctaaacttcatgtcattgcaagaaaattctttcctgaactgatagcgtctggaatatatctctcagtccacagactcctgttgactatgtctgtgtgtgagatgcaaatggagatctcatttgtagtcacttccttagagtgattgccaccttcctaacactgcaacactttgatacagttcctcttgttgtggtggcccccaatgatgaaactattttcattgctacttcataactgtaatttttgctacagttatgaattataatgtaaatatctggattttttgatgatcttggatgacctctgttaaagggtcatttgactccctgtacattctttggtcctttgatcatttgtatttctcctgtggattacttgaaggtgtatttatcttttatcagttctcctttgccttacagaattttaattgaggatcataaccattcatccatcatattgattgtatctattttccaattcattgacctttcagtgttttaatatcccctttgtccataaccttaaatcttttagacacttccctggggtttctttgagcacataatgagttcaacttttgtatttaatcatgtagttttctatcatcatacatggatgtttggggcttgtagcagtcttcctgcctcaagtttccagttgctctgatcgtgtgtgtgtgtgtgtgtgtgtgtgtgtgtgtgtgtgtgtgtgagcacctgcacgcacacgtgtgtgcatgtatgtgtgcatgtgtgtataccaccatgcccagctgaggtggtaggttctggttctaactcttctcagaaggcacattctgagttttgatcagggtctgtggtagccctgtgcaggaatgtagagaatggaagcttttggagaagctatgaaggccagagtctagatgaacctgagactcatgtgtgtgagtgacctggatcagggcaggcctgggctgtctgaccctcctctcgggagaaagaagctggtatgcacctccatcgggtcccagccccggtcggtgttctactccttccagcacttcaaaagaagcctgaagtttgaatttttctaaaatcatgaaatctaatctttaaaagttggcaacttatttaaaaaatgtaaagtcacggagcaggccaacctagctggaattaggttaccacgggtagaacctaggatacacattcctgcttgagttgtgtagatggagtgaagctgtctggcttccaggcaccttgacactctcacaatgcagtaacagcgacaggtgagcattgggacaatttgcacgctgactaggaacagtggaggagagacaaacacggggcaattagcagaccatggtagcagccatgcactgatgggaatagggtgtggtaaagctggagatgagaccatctggagggctttctctgaggatttgaaactggagtggagtctaagggaaaaaacacaagtacatgaaatagagggtgacttacaaggcaccattcagtggcttctgaatggcaagagctcagtgtgtctacagggagaaaataagacctggctagctggtctaccccatctagctactgacacttgagtattggtcccattcagttcattttgggttcgtttatcacaaagtagtgattattggtctcttcctaagtcaggcatcatgctagttgctgagatgaaaaggtaaatcaagaaactcccaagaaagcaaattctggaaggagagggggatgggaaacttccatgattaaagatgctgtgttgaaatggaaaaagtgcaggttgtttgcacttggcagtcaggagcgagggaagaggatggttgaggcagagagatctgcttcagtgagaaggcagcatagagtctagagaggggcattgtgctcaggactctgcacagggtctccatcctgtccacttagacctttatgtgacaaagactacagtaattggaaccacgtggacatcgctgaaatggaataaccagccataggcacttaaggaaggtcatgcacatgagagaagggttggagagtgaagaagtgactaggaaatgaaatgctctcgggcttgggacttggtagtttatgtgtaataattaaaatccaaatatagacgctttttctattatcattgttactgtgataattcctgtcatcagagtgcagcactaataccctctgacgctgacaagacaccctttctcttttctttcttattcccacatcagtatggctccttgcagcagtggatactcacagagagttctgaggaataactcgtcacagcaggcacatgtgttcacggtgtttttatggaacgtaagaactaagaataggcattgggcagtcagggatctcacttacccagtactgatggcttattttcattttatagaccactcttggccagtcttttcacatagctcagtgtagacagggcttggcactgtcttccctcttgctgagcagttttcttacttgtgccaatgataccacccttctcttgagccaatagttgtcatctcctgccattgcctcccctacctcctgcataaattgtacacaattgtcttttttttttctgtttttgcattgttgtattcctcatgttcacccaaaccacatttttacatttgtggtagatagtgatttgatgtgaagggttttgcacaggcttgtgtgtttgaagacttcatctccaggtagtgctactgtttgtaggaggttgtagaacctgtgggaagtgaggtctagctagagcaagtgcatctcttagagagtggactctggaattttataaccttccatacttgctgtcctgtctctgtttcttgatccatccagaagtgagcaagcagccttgtggtcctgctgctataactgcagctactccagccaccatgccttccccactgtgtggactgtacgctcaaaccatgcagcaaaataaatccttccttcagttgttacctatcaagtatttgattggccacaacactgaagcagagtagttaataaatgctgtgcacactagtagaattacttccggttattttctgcgtattaaattgtttacgcttgcctggttgtttgttcgtgtgcaattattcatgcatagtcaattgtttgtgctcattggcttctgcacacttgattcttcctgcatctttaattgcatctttaattaattgcttatacatattcagctgcgcacgttcaattgtttgtgtacatttaactgtttatgccttggatatttaataaataggaaactcacaaatatgggtagtcatgagttctctctctctctcttttaaagaaaatttcaaaaacaaagtaaaatgagaggaaaaaaaagcttggatatgttagatttaaatccttttaataagcacgaaatacctttcactgagcatctaagagtcttgggttacctctgaattcgtagttagcagaagcaataaaaatacacaaaagtagaagtgggataaaattggactctaattttgagccgggtggaaggactgtaaagccaagctcaggaggagcagttatgtttggcttactggccgcctttttgttaggtttctgtgccgtggttatcagagcactcacctgaagtccagcaacagagcagctgtggctaagtgcctggctcctcttctccctcacacccatgctgacttcagctatatccacaggattcaaagtctcctgggagctgatgcaggtctttaacctcagcaagtggggggggaatcgccctggagtccactgcccagccaccccagctgaactaaggagctccggactctgcaagagaagctgctcaaaatatgatgtggggagcagtggatgaagacccctgatgatggtctttggcttccacgtgtgcacatgtatgtgtgagcacattggatgcacgcacccatagggacatgtgcttataccctccattcacgaagtccgttaggagtgccggagatatcagagagttgtatgttgtcgttcccattccaaaaggaaaatgccagcattttggcagcatatttcagccacttggattgtcacttggtgctaaccaaggcactctggggaggggtggaggcagcagacgggtaggtgtggctttgctgcttctcgccctgggatacttggttatgccgatgttttctagatatctgatagtcttcattaagccacttgccccttaaaaaatccatttcattgctgcaattgctcgagctgtactcatttcaagggctacgcatataaaatattctaaataccctgaaatcagtggaagtgtgtatatcactcagactgcctcaagtgtgcccctggggacaggagcagctcacctcttcccagcccccgccttccgatgctaatgtgtagtaatcagcatggcttcatttactttatttgcagaagcggaaagaggggtttgtaattggatccgtaacttccatcactaatacctctgaagggtgttgactaacttaccattatcatcacttgtgggaagtggaaacacagctgtatttgtcagctcacagaagcacaagcagcctggtaacatgtcagcagaaacgtggtgtagccgctgccccccccccccgcccccgtgggttgttctgtcctctgtcagggctgcacagattttccgacttcaactttcatccataaaagcagtgtaggctcctgtgagctttgtctgcaggccaaagtgtctttagtcacggtggctcttctgatgggtttcattaccttttaaatcatgtattggcctaactaactggctaccagatattcgtgtttgtatacacctcgcctgcttgcaatggatttgaggttaagtgagagatgcctgtgcgtaattgaacttttaaaataagaactcagaagccctgggagggaagatgatctaaatgttcaatgagctgtcactgatacactttctgcttgccagtgctgggtggagctgtggctaacacagagttaaaaataatgtgctgtactgtttgttagtgagcgtcttttactggtgttggaaaggaatcgaagtgagagcatactctctgtttctcagtcctctgacaggatcgatatcacttcccagttgtaatcaagagtcagcaaacaggctggagagatggctcaggctgttgataacatgcttgctgaacaagtgcaaggaaccagttcagatcctagttgtcggggaaaaggggccggccaaggaaacacaccctgagcagaaccaaagaaacacactttggccctggaatcagagccagtgaaagaaatacaccctggccctaaaactacagccaaaggctaaaagggaccagagaaagaaacacacttaggccctgtgcagaaaactaaccaatctctgagtaggagatctagccatcctaagctcagggattgaaatctggccaatccctaccctggaaatctccctggaaaaactccacccctaagaatccctgtataaaccctgtgcctgttcagcttctggccatttgggctgctcagctgtcctctgccaccctggcagagggcagtcactctcctggattcttccctcccaataaatctcttgaatgaggtttgggtgagatgttcttttctaggagcagagacgaccttgggcggagtggagtgaagcagggttgtaacacttgtcattgcccggggaaaccttcccctggctaagcagagttgttacactctgctctccaggatctggagcccaactggccgaactgaccaggaaaccctctcctgccagagcagagctgacacatctggggaagcctttccctgaagcagggcagtaagctgctatgcttactgtgacctgtggtattccttggctcccgagtgccagaatacctttccatcagagctgtaacactcagtattctgtgactcccaagtgccagaattcatccctgtccatcccatccgatctgtcagaatgcttacaccagtccccacctaaaaagctgtaatcttagtgcagtaattagaatgagatgcccccataagtcttgggcatttgactacttggtccccagttgatggttattgagggggattaggagacccttggccttgctggagaaagtatgccactgggggcaggctttgaggtttcaaaagaccatctcaaattagctctctctgcgtcctgtttatggttcaagatatgaactcccctcttctgctctggctgcctgccactgcctcctgcaccccaccatcgtgaaccctaaccctctggaactgtgagccccaagtaaaccttcattctgcaacaatagaaaaattacagaatatgctgagcactgaggaggcagaaacaggaggggccccagagctgactcaggtttgaggcgtgattcttgactgtcactggtgcctagtactgtggtggaaactgtgacacctggggcttttaagtgagtgactactactgtccacaagtgctgcagatgactggggaggtcgtggggaggtgtgactagatctccgtggtggttatgggctgatacagtttagttgagcaataagaagagttcttatgtcacctgtttatgtacgagtgtgcatacgtgcaggagttgtggttcacacgagaggaggtgaagggacagctgtatgagtggattctctccttgtaccatgaggactctggggaccaaactcagatcatcaggtttgatggcgtcctgccttctgtgggcctcagaggcagatgtttttgtcaaacagaaagcgtgttcggaataagaataaaggatgatatttaccgggctgtgtgtggaaggtcagtctcctaggacctgagatggcaatgtgaaatgatgggagtgggtgggggagagtggggtggggggggggggggtgggtggggggggggtgggggcgtcttaattacttgtgaaggactagatagggaagaatccacacgaatagaatgctcgtctcaacgcaccacgcacacggttcactcttccccagcgtgcccagttcttactaacatgacctatagttaatggaacgataatggttttgtaaaacattaagcatcacaaaaaaccggtgcaggcatatgcttcagaaaatacccaccagccccaaagcatcatcaggtcaagtcttttcatggttactgttgtctgaatcctagtttatatcctggtgtcactcaacatctattcaaaggtaagtctgtgataaccgaacccaagagcacacttaattagtcaacgtataagtgaaggaaaacactttaatgtcagagcatcaggtgatattctttatgcatctgtgcatgtgtgcgtgactctgaaacatacagcaatatgctgcatatgtgtttatgtgtgtgcatgcatggatctgtctagagcagcgttctctgtgtgtctgtgtgtaggtgtacctgcctacactgtttgctgattatctgccttttgtaactcagatgtaaatgaagattgtttacgactacacagccgactttccatcccgaacactctctgtggacatgtgaagggtgagatgtcaggacagagtccagctgacattctttctgttgatagatccagtgatagaattttaaatgtctcaaaataagcttttttctgttataacagccaaagagagttgtatgggtattcgagccttattaattagccacaacttggctcaactctggtcttctgtgtctgttgatcagtttgggcttcagaattacttaaaggggcacagaaaggcaccaggtcattgcaatagaacaatactagatactggatggtaaactgttaagttaaagaaagcaacccttcagattaaaaaaaaaaaaaaatccctggatcatgtcacacccaagagactgactgaaattatgcagtatggaaaactgtggtaagcccctgggtaagatttttgttatcaatgaaagaggctccactttagagataattaaattgatgatttcaaggtatgtagttcgctcatctgtctgtatcatatacatacatacgtacgtacataaatacgtatgtgtaagtttttgacagctgtgtaaggcctgtaaaccactatgtgccactctgggggtgggggccttccagtgtcagccagtaaatgtctggctgtgaggcttgtgaggccatgctgacggctgcacacactgcactctgcaactccagtacagaagcagccgtggacacgtaaacaagccggtctgcttgtgtttaccaagtgagacttcattttatgaaacaggtggcagaacagattttacccaggagggttgtttgccaaagcctgctgtaaatggcttttataatcttcacggtttcccatgccccatatctgaaatagcctgctcataatgggctgggcctacacagtggctcagcaagaaagcctcttacccccagcctaatgacccgggttcaacccccaggactcactgatgttaggagagaaccaactctcacaggttatactgtgactaccatgctctgtgacacatgtgtcccagccccataaataaatacgtaagtataaagaatgagaaaaaatgggctattttttctcttttcatttttttttcatccttcaatttttattttttggctcaggctctcatgtggcctgatcttgcctgaacttgttatgtagtcaaagttggatttgaacctcttaaccttcttgccttcatctgtagagtcttgggattatagctgtgtgttgctatgcctggatgtatacatttataatttaaaaagtaaaatatgagtatgtgtttgtgagtgagcatgtgtgtctgagtgcctgagtatggcctacggagccagaggtatgtgaagttacaggcactcgtgagtccacccacataggggctagaaatagaactcaagtcttctggaagatccaatgtgctcataattgctaagccatctctccagtgcatagttctaaattttaattcactttgctttcttctttgttgttgctgttggtgctggggattgaacctaaggagtcagaggcatgcgaggcaagcggaatgccggtgcccttctctttgcgtgtaatcctgtaacaccacacacaagtagagacacacacgagtcacgcttttagtagaagggaaaggaaggcgttagaggtgagcttcctattactttgatgaagcatgaccataagcaactcgtggaggaaagtatttattttgcttacacgtccacaccacagtcttaccactcaggaaatcggtgtgggaactccaggcaggagctgaagcagaagtcatgcaggggcgctgctcactggcttgcgcctcctggtttgctcagcctctttcttctacaccccagaaccacccacagtgggctggcccctcccctagcactcactaattaagaaaatgcatcaaggaccaatctggtggagtcatttccccaactgagggtttggctccctctggtaccaacttgacataaaactagccaggacaaggaccttataatttcacagttgtgtgatttacacattatgtggacagtggactctgacactaaacgaggacccactaagtatataacagggcagacaggtgtgtgctacccattgggccaagaagatggatgagtccactgtgaaccagggatggcactgaatcaggcagagtagaagcaggaggtccaggctcagcacaaaccaaaggcattgggcaggccaaggccgtttctcgcttatgcctgacatgaacttgggaaacagtgcaaagcaaacgtggggtgctcaaatggagtcaactccaattcctggattctgtctgctgagacttgggttggatcttaggccatccagggtatttttatttaacgtgtatacaaaccagagtttgtttttttttaaacccttctctggatttctgcccctttcatcttccttctttcaatgcctgataggtcaaccacctggccacacaaggctcttcccagtctttctctctttgtgctttcctctcccgggcatcgccccctcccgactgctgcctgctttccctctgctccccccccccccccaccgcctcgtctcagaagcttcggaacttcatctccatttatcaagatatttacctgataacaaacaaacaaataagcagaagctcacagtgaaagaaataaaggaatcccatctctcacagcttctgctcgtgttctccttggccctgtagagcaacaagattccacagcgttggaagacggtcagagacatcaggtagcggagtgggccgcctcaggtctagagcacgtgctagtcttacttagggttttagactccttgccctttctggcttctcctccaggacctgacattttcatttcctgtaggcgggaagcctaaggaggaaaggaaactgacttgctctgaagtccccatcgccagctgatttactaactgggaatacgctagagaaagtgcaggtgacctggggcttggacagctcctagggaaagagctggctgttggccgacgatgtgatctgagcctggaggtggaaaagctgagtagaacagagcaaagggcttggttctaggctgtgggtgtttaggagccaatgggacacaggacaaaggaatatcagaagacggctctgtgcttcattcttggcaagagaaggtaggcttgagtgtcaaggttacagacatgcctatagatggtgtttgaaattgtggtggtgattagacttcctagcaaagcacctggaatgaagcaggtaaaaccaagactgaaaacccagagtgatttcaaatgccaaaggcgggctaaagggggggggggcaggaggaaaaggacccccgggggatggctgggaaggagaggtctgagacagtggggtacaaacaggggagctgtgaggctcagcaaggttggacaactggccctgaagtacctggtgaggaagtgcacacctggctttgacatgcagcattcctgtgacagggcaggcagtctgtgttgcaggctcattcccaaactggaccataatgagcaggggagctgaggggtttaaaatatccatgccaggattcctggagtctcttcataccggtgttcccttaggccagtggcattacctaaagacaaacagtaaagagttacgtagacacactcagagggtccagtgtgcaagagccgatctctgcccttgccaagggttgtctctgtgagtctccactctgtgtggtgctctgtatctctcatctatggcacatgctttggactcacaattgtgctaattaaatgggcttgggagttgcactgaggcctcccactcacatgtttgagataaagcaagaggagagaagcatggctgtccaggggctcgttagagcaggaaagagctcagactcgcctggggtccacatgctaagtgggtgcaacaagaggacccaaggtgagctgcaaaagggataaagaaaggtgtctgagtggctggctttcacagagcgccatttctgtgggctggctttccttgtccattcctcctcatcgacccctgtttttattgattctatcctccattcagaagccccccttagcttgctttccatcatagttgatcactcccacctgtttaacaaccagtttaggcacacacatccagagcatctccatggtttagggcgtgagtggggccgggcagccaggcccttcctggcttctcccctggacttgacattttcccatttcctgttcctgtaggcagtagacctgaggtactgaggaggaaggaaattcagtcttgtaattctcccccacctgtccctaggttactcagggcccctccctcagtgaatgtcatgtcctataagcaaaagactaggaagatacccatgttttcttgggcccacccacctccctggccagcccagccagcctcccatcagccctactaccctccagcagcctctgaactctgtttccactttagttcctttccagtccactctccctaaagaagtcaaatgccaccagcgacgccccgtactctggctaatggaggtatgcaccatctggctttggatacccatcatggttgtgctcaaagtacttggcatttgcaccaagtctcactggccgtcagtgagtctttgagattcatattaacgtgatgctctcggtagctccacctacagagaagaaagttggagtacaaaggagcgacagcttttgcccgtggtcatttgaccctgggtcttctcagagcctgtggtgctaactggactcttgacccacctctgtcccattgctcttcaaaaaccacttactccgggatctgaccacgtccttcacaactgtttggtccttgtcactgtggtctctggtggactgtagcctcaggctttgttcttcctgcttctgttcacatgtgcaccccaaactttccctgacacagtagccacagtgaaccccaacaaagagattatgtcatgcccaggctaaccctggtctcagcaccttctgacactcatttcttagcaaaagtcttgtttctgccccccctccctcccttctctccttctttccaagtgttttagagacagactaagtagcccagctggcctcaggctcatgtccatcctcctcctctcagcctcccaatgcagggatttcaagtgtatgttgtcacatgtggcttaaaaatcaaatatatgtagtcttgaaagccttgttgtgtgacctgggccccagtctgtgccttcggcagtttctgcctcactttctctgctcaggatacagagctgtgctctgaaaccacaaattgtagccatggtttgtgtcttttgagcttgctactgttctgttctgttacattttcaggaaaatgatccctgatgatttgattttaaatggcagcctctgttccacgctctcggctttcttctttcttggccccctgataggtccattgtcctgtgtgtttgtggggagttcctggaaggcagggtttttgtcttttcactctcagaccccatcagaggtaacttcgctcacaccagaggctaaccagagtgcagaagtgaggctggagaaccaggcacttagtccacagtcacctgcttttaaaggagatcttttgaaattggattagaataagaggaatttttacatttgcatatgaatagtttgtggatctgataatgttaaaactcacgttccatgtatggataatcaatgatctcattatgtcataacaaggaaatttatactacaggtaacatctttgtccaaagtacctgtgtgcgtgcattcaatatctgtatggttaaatgtcatcctcactggtgcatttttctaaatgagtttgtctaaattttctttcttcccctcctttctctcctgccggcctctgcttttgtttgcaagctgggaccctcaaccttcagaacggtcaggtgccttctggtaactgagtaagcgcctccactctctgaaactttctggcctctttccagttctgctagactgctgaggcctttccaagagctgagattcaccctgcccttgcttgctccattgccgggcaggggcttgttgcaacacagagttcatttgagcaataatctctttctttacaaaccactgcatgaacacaagctgacctttctagtagctgttccttagttaaacagagacagcggtggcctgatagtgctaatctgctgtagctcaggaatagaggagaaatattcacagggtgggagggagtgcccctctctcagtgcctccgacaccacccaggctttacatctggctaatctgtgcacttcacattgcttctgagcctgccagtggttttgtggagcactgtaggaatcgccactataatttcaagcctctaattaacacagctggcagtggctttgccaagactatgagcaactgactcagtcttccaggaggaggtctggtagataggagctgataggagctggagaggaatcctgggctcttcactgagcaagggagtttgcccagggtgtgtggagcaacagtagctgcatcctccagaagccctctgtggtgtgttgtttgccggtgtcacagcaaggcaatcggccttaaaaaggtcaagtgacttgaacgtgttctcgtgaaagatcggtgggaccagcatagtcactcatccagctgtcactctgcctgcacagttgtgattcatcaaaatctcagctccttctgaaggcggtgtctccacctcccggttccttgccctaaaggatgcacaaaaattgccaggagaatgagaacgcctttgacaagagaagcaggaattcattcttcctggtttctttaccatctcaagaaattactgcttgattctagaaataggaattaaaacacgttctaaatatttacatggattatgccaattcatcattttctaaagaggggcctgttggaaagttaaacatgtggatcattttaaagtagagctgtcaaataatgaaaagtaattgggctatctaatcatctgtcggccattgtccatcagtccatccagcaaatatgaaccgccgttgtctgctggacacacatttggataggtggggtagtaaatagtaagtaaaacagaagcaccacccttctagacgttctgcgtgagggagacactgacttaaaataaggatgatttcacactcctgatggtgaggagagatccctgtggtctgtgtatttggtcttaggtatttcccaagccatgtttgaagagccctgcaggaggaggcagagagctgtggtgggtgggaggacccacgtacttctttctggtgcttgcaggactttgtaacacaaactaataaatgacccagagactgatattggggttcagtcttcaagctgaagatcagggaagcaaagcagccaggccactagctctcacctctacctcaggctgaaagggctggtcctgtctccatgagctctcaccaagcctcagactgtaacttctcctcagcgtggctggagaacaaatgcctctctgagaccttgcttctgtcttacatacttccctaatgttgggatgaaaggtgtgagctataattctcttttagactgagtcactcttgtgtagttctacttggccttggactcatagagatccgtctacctcttaatcctgagtcctaggattaaaggtgtgtaccaccacctcctagcttctggctgttgggattaaagttgtgtgcctaacttctatggcttgtggctgactttgcttttctgaatcctcagtcaagctttaataaatcataaataatatatcactacaattccccttttttgtccaatacaaaaagaagtctacaactaacataagaaaaactatatacaaaaagtacaataaatatatacaatatatacagacaagttcatcaacaatgtctcagagaaaatatctagtccatttgcatttgacaattctgagaaactacttcattttctatcctaaattggcgagtccaaagtcttgtagctaatttactttctattctcatttgctttattaaaatactttaatgtgtctcaaagcatttacactttacacatctttagtgaatttcttttctaaatctggtaaacaatgaaaactataactatgctatccagtcttcagctccctcagagactgaagaaggaagtgatattaaccgaataaacaggaagtgtgatcaaatgactccccaaaactgtgagaaatgacagaaacagctggctgtctggacagtcacccaaggttcctctgcagcattgagacatccatctttggcctataggcctagcatctctcacagacatttctgtgaagcaggattttctgaaggagtggactgccttctcttggcaaggtttcgcactcacactttttggtgttttgtttgtccattttggacagcatactgtcagcagcagagacaaaggcacttttcttgcccagtgtcttacctttgccacaaagaaagtaaactccatgtgagcttcttcgatgcccagcatcttctctgaattatattgatgctgccaggagcagacacgtctcattgtcataaaaaaataacctatgttattaaaacattttaaatgtcatattctgtagatctctgaagtgtttgaagcccaccctatgtctgtctttgaaaacacactgaatgtgactacaagttcagttgtaataggtggctaattcctcacctacaggagtagctcaggtaatggggccctctcatatgtgagtctgaagaaaacacatcacttcctgtgtagaaagagggagacccagaagtcttaaagttacacctattaacccgtcgtcagtcacatcaaaaaagacgcaaagtggagggcacttgtctctttcatcagttccacagaagaaaagcggaaaccttaggtgcccctttaggaacccctgttaatgttacttgtgtttgggataagcccatctagtgtgaagaattagtttcttttcttgccttcttttagattatttttgaaagatactgagtataggaagatgccctacatactgtcttttctcagaggtttagtcattcagataatagtgacttatattcttaatcgatgcccctgacaattaaactttatgcccatgccttttattaaatctgtcttgacattttacctgcatgtataactgtgtgagggtgtcgggttcctggaactggagttacagacagtggtgagccactatgtgggtgctggaaattgaaccctgggacctcaggaagaggactgattataattccagcacttgggaggcagagaggcaggaggatctctgagttcaaggccagcctggtctacagagtgagttccaaacagccagggctacacagagatagcatgtcttgaaaacaaaacaaaacaaaaagtcctttaagaaaggaaagtttgttaatttttagttttctgtattttaaagtggatttgtgatgacgaatccaaattgtttctggtaatgatgtctaccgttaggacagaacttggcaaatgttagctggattgaagtcacatgatggtgtctcagtttctgaatcagaaggaggtgctgggatttgcgtttctagctcctgcccccttgcagacacattcttttaggaggggtgtgagcagctgtggagtggagaactgtttccctgtcatgacagctctggcgttttcctcagaaacacatcacagggagagcttacaaaaaatgcttttaagtactttgttctgttgggacattctttctctctctgtctctgtctctgtctctgtctctgtctctgtctctgtctctgtctctgtctctatatgtgtgtgtgtgtgtgtgtgtgtgtgtgtgtgttgtatatttgtggtgcatgtatatgtacagggtacgtgggtattgaatgtgtgggtagtacatgtgtgggtgcctgtatgtttgtgtgtgttacacatggtgtagatggaagttactgtcccccaccaggtcctgcagctgtttagtcccaaataaacacacagaggcttatattaattataactgtgtggtagatggctcaggcttattattggttagctctctcttaattattagcccacaactattaatctgtgtatctccacatgacgtcctaccttcctgataggtctcctcccatggccgctgtctcacagctcactccctgcatccatcttccacaccttctagtctggcagccccacctatacttcctgcctggctatatcctgcctgtccattggccaaaacagctttattcatcaaccaataagaaaagcatatattcacagcacacagaaggacatccccatcacatgtgatagtgtgtgttttgtatttggggaagtgtgtgtgtgtctcgaacgtgtgggtggtacatgtggaggtgcatgtgtgtaagggttggtatttgttttgcatcctaagctttttcttgttatcattaaaggtttttttttttttctaaaattgactttactgtaatttaagacagactctaatagtaggggtgtaaatcatctgaaatatcaagaattttcacctgtaataatcaactctgctcaattccttgttacttttgcatgtaatctttgtcttactttggtcaccactgttatggaaataattaacagatctctaagagccatagtggatttatttaaatattggttatataaaacaaaggatgtttttcaaactcttgtaaagaggctgtggagtagccaggcctggtggctcatgcctgtaatcgaaacattcttggagccagaaacaggtggattgccttgagctccaggctagcctgtgttgtacagtaagctccaggcaagcctttattacacagtaagttccgggccagcctaaactaggacgtgtgtgagtgagggagagagacagtgaagaatagtttgctaataggaggaagaagtattctgggctccctcccccaaaccccttgtggttaatggcaaaggtaaatgtttccttgattcccgtgtcttgagaggatgaattgatcaatgcagagacagacgatttaagcagaagtttacttagcacagcaaaggacagcacattccagaaagaggagggaagggttgggaagggatggccagaagggtgtgttgaagtttcccttccctctcttttagggtacttcttcacatagcccttttgagaggcccaggggacataaacccaccgtgtaggtgactctgctgtgaagtctggctctttgatgatgcaaaccttttcttcgtgcacatgtgtggtgtttgggaaagtgccctggcgtttaggtttctattatagctagaagagcctgcagcttcaaggatgtttgaccacaaggggatttctgaccttccggagaggaccaccaagatgcagctgcgtttccttggttacctcagcattggttccttgcccaccgcatctcaaagggaccaatttcttatttcactgtagaagggtgatgtgtgtgtgtgtgtgtgtgtgtgtgtgtgtgtgtgtgtgtgcacgcaggtgtgatgaaatgccaccctgagatgtcatactttactttggggctcttgtcttttggcctggaggtctgtgtgtcctccacagatgtctttcagggtgtccagtcctagtctgtcaaactctagttctcagaaacgtcactctcatttttttctaatgccaacctttttgttaaccctgctttctttgagttctcaagagcttattttggatgtaaaagaaaatactgttcctccctctttctgatccagttttggtctaaaatatgttctaggcgatatgggcgccggtttgggactagatagcaaggacggttgggaaagagaagaactttgtaacagccactgagcggttggtgaggcgcgaggctccacccacctctgcgttactcctcctgcccccctcttcttccctcactcacctctgacgttctcacccccccttcgggcaactctgccgttttcttcttgagggaagaacccttcctcatggtagtctccgtgtcctgtccgacctcagagcatgctgggagcttttggccgggttttgcaggcaaggttttgtatttccttgaacctgttccgtcctccgctgttgtttcttcagatgggaatgctgctgggtgtaaatgcaccgttcacttattgacctaaacacaaaggcagtcatgtgacttggggatcttcaaacggggaaaaccaactccctgtcagttttaccaattaataatagttgaacatacactgaaaaaaaaaaccttagatagaagtatcaaggtataattaccatagaacagcattctggcacagtcgctggcttttcttgttattgtccagtccttacttggggccatattaaatcaacattgaaatcctagtgatagggagatagatatgaacaagcattttttcaagctgtattcattgttagtggagtttgggactttgtggtcggtcttcatttcccagttttttattttaaaaatatatgatggtgtataagacactgttggtgattatgtatgtttgtgtataaggtttgtgttatacatataggtgcattttatgatatacatacatatacatttagtgttacatttacagtttttactttaaaatttttatgtgtggatattgtgctggctctggtacctgtgcacccagtgcacgcagttcttgaagtggccagcagagggtgctgcatgtcctaggactggagttacaggtggttgtgagctgcccggtgggtgctgggaaccgagcctagaaatagactataatggattaagggttgtgaagagtcaagtaaagggagagagtggtctgactcacagaaggaaacagagtggaaggtgagggcagagaaatagctgattgattgatgtgacgttacttaaggctcatttttggttcggactgaaacttagagaactttattgttaatgctgactggcaccagctctggagagaacttgtcccgtgagctctctggtgacctgttggactacttaaataggcttggtgacttggaacttctgtgtggtgtggttaaacctgctctgttggtgccagggaagagcctatcccaaggcaatggcctctgtgtctttatttttgcattcctgctccttggttgttgttgcaggcctgacctctaccaagagctttgacaaactgatgctacaacctgtttcttggtctcctttatggtgacactgtggtgatatattgtgtatggtttattaaagcttgcctgaggattcagaaagcaaagacagccacgagccatagaagccaggaacacacctttaacccccagccagaagctaggaggtggtagcacacacctttaatcctgggactcaggtagacagatctctgagttcaaggctacccagggatacaagagattgaatcagtgtaaaagagtaacagatcacacgcctttaatcccagcactagaagggtataaaagatagaagcagggacttcagtggtcagcaggaggcatttagtctccagccatgctgaggagaggttacagtctgaggcttggtgacagctctgaaaacaggatcagccctttcagcctgaggtagaggttagaagctagtggccagctgctttgcttttctcatcttctgctagacgtttgaacccctctatcagtctctgggccatttattttttgtgttacatgacactagaagctctgggtttccaagttttgaccttcttcctcaatgtattgctgtgttgccaatagcactcagcgttcctaatcttccactcattcgttctggactcacactaagcagatcttcaatgccatgacataacagctgaggcgaacagcttatgaggagagaaggcttattttagtgcatggtttccaagttttgtggttgtggctttaatgcacaacattgtggccttgaagaggatgggagagatggtggtagaacagagccgtccaccacgccatctgggcagcagggcagaggaagaaaggagaggctgggaccaagggctcatcccaatgacctgactccctcctgtatgccccccccttaaggtcacctcaccttcccatggagtctccagccttcagcataagctgtgggaggactcctaagtttgaagccataacaggtccttacctcttcttcctcccattcctgatcccagtttgtaagtcatgtcagttctaccccctggaactgcccaattcttgccagttgttagtacgccccagtgattctaactttgaggaacacctacaagtcgcagcaagtttcatgactctggatggtcataaaaatctatataattcacatttagttgaatataaaatgtaagtaaaacaagacatcatgatcctaaaaggcaattctaaaaataatcatttcaaaaatgatttgttctggagtcagtggaatgaatatttaattgatcaaactgtcactttccagggtgttgacttgggttttataggtctggattattgcttgaatctgtattgattccttatggtcccatttatattaagacttcatggaaaacaggatgatatgtttacagccttgtaacaccaacaaaatactgactctggaactgaactgtctgaggtcagtactaattgcttttgccagtttctaactgtgtgattgtaggcaagttcacactccctgtgcctcagtttcttcatctgtaaaatggaagtgatgcaagtgtctactccaggatttctgagtaggatctaatgagatcttgtacctaaaagcttgcgggtgggagacagactccgccagggttagtgggttggtgtgacacagtgataccccctaggagtcccctggggaactcagggcagaaatagaacatttgcacttgagagctcaaggagattgcaaggtttcaggagttattcaagtcatctatgaaaaagatactccaagggaatgtgtattaattatctacaaagtgagagaaatacccaacaaatgccttcggtgttcagatgaaaaagatcacttccactggctgaccgaaagcagtttgcagtgacttacagacagggtggggaatgcttggctagagtgcgtgagaagcagagttcagacaccagtgctcacaatacactgggcacacagcacgtggctgccgtaatcctagttctcccacggataacaggctgcctacttggtgagctctacacttaccgagagaccctgtcttcacaaataagatggagaagaatgatagaggtccacctgatgttcacctttgacctccacacacatgcacacatatgtacacgagaagaaattatttatcattagattgttgggtttttaatgcccagtttcaaatacagtgtaatcgaaatctgtgcccataaagcgccagatttgacctggtcctgtgcagaagtacaggttaggaagaactgctattgtagggctgagctccacgaggtgagagagagccatctgggtagagagcccgctttatgtgtctacagcagcgtagcctttgtgttgtttctacagcccgctgccctgctggtcacagtaatttacatgcatgtgtaatttaaaggaatttcatcttcccaatgctgccgtcaacatttcttctctgcggtacaaccgcacatttgttatccagcaaatgtgagcactgattcctttttcttttttcaagacagggtttactctggctatcctggcactctctctgtagaccaggctggccttgaactcacagagatcttcctgcttctgcctcccaagtgctgggattaaaggcgtgcgccaccaccgcccagctgaatgaccgattcttatgcttctcaagtgtagccataaccttcctagaatgtggctaattactgccaacccaggactatgaaagacacacacacacacacacacacacacacacacacacacacacgaatggacagaggaacttcaaagtcttatcccaagagaagggtgcagagacgttaaccctttaattctttttcctgcagttggcccgacacaataaactgcttcagcagatgctcaaaccaggatctgatcccgaagaaggggacgaagccttgaagtattacgccaaccacactgcacagattgaggtacttactcgtgacttttagaaaaatctatttgcttactagctaaggccatttccatgatttttctcagaactgtgaaataatatttgatgatttaagtggaaaagactgtctcgcaggccgatgcctaagagtcacatgtggaaactgaatgtccatcttgcaaagtcttttctctccccagaactagtctgaagtatagatggagtgttttttgttcagcctggccccacagccatttagccccaaataaacacactgaggcttattttaattataaactgtttggctgatggctcaggcttcttactgattttctctctcttaattattaacccatttctgttaacctaagtatttccacgtgctcttggcttactggagaatgcccggcatcctatcttcccagtagctacatggcatctctctggtggcgtctctctgagtcctctctccagaattctcctcatctgatagttccacctatacttcctgcctggctactggccaatctgtgttttattcatcaaccaataagagaaacatatattaatagcatgcagaccggacattccccatggctgaagtttttgaaatggagactaaattttttttctctcgtttgggtcacagaagcagtcagggcagaccagtgacactttagagacaacataattactagagaatctgttccttaaaaattgtgggaacttcttatatggagatcatggtggcacctgtctttactcccagcacgtaggagacagaggcaggcagatctctgtgagctccagaccagtctgggttagaaaagtcaagggcagccagagctacacagagagaccttgcttaaaaaaaaaaaaaaaaaaaaaagcaaaataaaagtatacagaaaacaccggcagcactaatagaattttcatgttggtgtcacacactcaaggtagtcagctgtttacactttgattgtctgacagctaccctctccctgccccataaacgagtcatcatctactgtctggtggcagatcaggaggtgtcacttctagctgggttatcattttgatgcttctgggcagaactaatccgacagaagcaggtagaatggtggccaccttgtcattccaggttcaaaacagcgcatttactcattctggtagatgggttttagtttttagcaggatctatcaccagcaccgtttgctctatggtgggtgatttctatgtcttattgcttatttttgacaactctctgagcgttaataagcaatatcacttcatgccaaaggttgcccttctgctctgtgtgtgaacagcaacagagccacagcttgcatcagatttggctgctacactgacccatgtgttaatgagaacgatagcttggtgtgatcagtttaataactctgggaagtgggaagggttaggcctaatcaccgtccgagaaagaatcccccataatccaaacctcactgtcagcccctcccacgagtctctctgcttcagcagaaagcacgtccagttttaatcagtcagtcattggaaagatttcatgtatctgtgaagagctcacactagaccattgtagttatccaccactcccaatttcccagtgtttgctcccttcagggtgttaggggtgtgcgtgtgcgtgtgtgtgtgtgtgtgtgtgtgtgtgtgtgtgtgcgcgtgggtgtgtgtgtgcgtgcgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgtgtgtgtgtgtgtgtgtttgcatgcttttgcatatgtgtgtggtcatgttcgtttgcacaggagaggcccaggctgatatcaagaatcatcctctgctattattcttccaccttactcactgaggcgggctctgccatctgaacccagagcctgctaacacggctcctcttctaaacagcttgctctgaggatcccctggctcttccttccatggctggaatgacagggcgctggcacacccagccaaggcttagtgggtctgtggagatctgagctctggccctcatattttcatggcaagtgcttttaaccagcaagctgtctcctcagcccttggggattatcttgttttcttcactttcagtaccatagtgctgctagctaatgactgagtgagcattcattaaataatcgggggaaaaattaaccatatttggctttcttcggttaatgcatttccttcagcagtttctctggtttgtcattgccctttgtaaaatgtgacaaccagaactaaacatgtcattttatgcagggactgaatattttggcttatctaatcaaagcttattttctttagtaagccctaagaatttcttttttaaaatacttgacactcttaactttcttttcacatggttgcctatcataccaaatatatctaagtagtttgtacaattgatattctaacctttttaagttagcatataaaggggctggagaggtgatccaggagttgagagctctggctgctgtggcagaggcctgtattctggtcccggcacccacggggcagctcacaactacccacacctccagttccaggatcaaaaccaacttagagaagggagattttatttttggcttaaggttccagaggaagagtccataagtcagggtaggcacagcactatggcaggggcgtgaagctgactggtcatattttattcctatgcaggagggtaatggaagagaaaacaagaatataaactctcaaatccacccccagtgacacacttctccagcacggctgcacctcctaaaggttccatggtctccccaaactgtgccaccaactggggagcaagagttcacacacataagcccatgagggacatttctcattcaaaacaccaaactgtaggtgggacaacactttaatgataaataaagatacctctctgtgtatagagaactcaggacacacaatgctaatatcatctgtttcccagagcccctcttaggaagaacaggacacaaatgcttacgtactaggttcaaggtcacccagctggtttacctttttcataattggattcataaaaatatcattcataaactcattgttctagtttcatgtctgttcccatgataaaaacagtcttgccaaaaccaacctggggaggaaaggatttctttggtttataactgcatgggagacattaccatggtaacctgagctagacactgtaaagaatgctggctcacctgggcttatgcttagctagtgttctgacacattccaggaccacaggcctggggatggcgctggcatggtgggcttgatcctcctatatcaatcaataataaagatgcccacagaccaaccagatcgaggggcttcctcaacagagcctccttccaaatgactcagagttgtgtcaagttgacagtgagaactaaggaaagcttggcacccagctgtacatccactaggtgaccccactcggcgcttctgggtagttcagaattggaagccacacggatggtcctagtcaaaatctatgggggcaaccaaccaaaaccaggaagtaaggagaacaggaaagagttctacagggaagaagcaggcctcggggaatgagggaatggcggtgatggtaactgaaatgtacgtattacatgcttgcatggacttgtcaaagaactaaacgtggcaatcaagaaaagggaagttaaaagtggagtccagggctgaggtgtgcaaatggctgaaaacaaatgaaactcgtttccagattgtgcggcacgacaggactatggagcagattgtcttccctgtccccaacatctgcgagttcctcacccgggaatccaagtaccgagtgttcaacaccacggagagagacgagcagggaagcaaggtgaatgacttcttccagcaaacagaggacctctacaacgagatgaaatggcagaagaagatcagaagtgagtctgaatgaagaggcgtgtttaacgtccccgagatcacttgcagggtggagcgtgtgcagaggcatgtttaatgtccccgagatcacttgcagggtggagcgtgtgcagaggcgtgtttaatgtccccgagatcacttgcagggtggagcgtgtcagccctcctgtcactgaagctgagcggtctgcagctcagtggacgcagaaatcccaggttaatgagatggcctgcagcttctgagcatgcttgttaatgtattatgaactgcaaggctgcagctgcattgttgcactgccggatggctgcaggtgtgaaatcctgcactgactccttgccctcaacactcagtgtatgtgtgggacaatatcctcatcagtgctctcacccagtgtcctacggtcagatagggctcccccccctggtttcccctcccctctcttcctctccatctgtaactctgtatgtgtttagacagggtctcacagctcagtgagtcctcaaattcactatgcagccatagatgactaagtacgtgatgttcctgcctccacctctcaagtattacttaagagtttttccaggagtcattctttcttctacctcccacccccatctaaatccaccaagcgaaacatttccaaacagctgtagtcagagagagtcaagtgatattgcagtcaaagccatcgccacgcagctctctctttgcaacctaacctgtaacataactctcctatgtatttgaaaacactgagtttgaatttttttttaattttaatttttaaatcattttcttgaggctgtggagatggcctagaagttaagagcatgtattgttctttcagaggacctgggttctattccttgcacctacgtggcagctcataattatccataactccagtttcagggttctggcatcctcttctagcctccagggcaccaagtgcacacatggtccacaaggcaacactcatatgcacataaaattaaagccttcatttgaaaaatctttttaagttgttttctaaaataacagaagttgaggaggggcggtcagtcctcttgagattagatcttcattgtctttggagactttcccagacaggtgggcatgtgtattatccattctccaccattcagttttctccgctctttactgagagagattaggagtatgaccagaactggtcagaggctctgttgggtataagataatgtcatgcagctttagttttctacaacactgtttctctttagaatcttgccacatagaactcagcaaaaaaagattggagcacctaatatatatgtggattattcaaaatttttatttgagatatttgaaaaaaataatttttcttcatgtaaaattaattgaatagcaagctcaaattaattcaaagttaatttagtaagaaactgggactctgttttatgacaagtattttttaataaaaaaataaaccttaaaataattcctagtggacattgtattttaaattctagaagcagagtatagaacaaaggtagaggcagaatctaaatgtttttgtgggctgatagaaacagaggaatgacagtggtgttgatgtctacaggccatgatctgttgcccagggggacagcattctgccacagcccctctcactgtggaacaccctctccaagacgagaaaaatgagctgatctcaggaggagacagtttgttagtcaatggcccagactggggtttgctctagatcccaaaagtggttttcattttatatgcctcatcccactgactctgacattttatcttgaaggttttaatcctaatttttaattatgtatatatgtatgtgccttttgtaggcttgtgcccacatgtgtctagtgcctgcaggagccagaagagggtgtcatagcccttgggtctgggttacaggcaattgttacctagttacaagttgaataatagacaagacccagaggagccgctaggtgcccagagtaggctgacagtttagctcctccaacacccccctcctgccctatatatttgctcagttatttagaagtggaaagaacagagtttctggcaagcactgtttagtagattcattcatcagctcatttctgatgacagacatgtattcccttttctagaaattcccgttttctttcaaactaatacccagccttctgcctcagctcctcagatgctgagacttcaagcctgagaaaccacgctggcttgagtaggttacatttctctagctcccatccatgctgtgctgcagcgatgagactcaggctttaaggtaactgactgagcatttccagtggggggaccatccaagtctgcagtcctggcttttatgacttcacaccataagaataagaccagtttacccatcagtattacttacagcacatatgtgcctgtgcccttcagtaaaaggtccccagaccaactagctgccttccccttaatctgcacgggccagatgcaaggggtttttactgcagaatcaccttcgctgacactcttgaaggacagaaaaggaaccaactaggaaatgcctttgccatctagagtctcacagtaagcttcctaagattagacacaatcacttcagatgcacgtctgtgactgttcacaggcacgttgcacacaccgttagcttagtggggctcccgtcgaccgcagcaataactgaccattctcacccttgtacttgttgcttcctagacaaccccgccctgttctggttctccaggcacatctccctctgggggagcgtctccttcaacctggctgtgttcatcaacctggctgtggctctcttctaccctttcggggatgatggcgatgaaggcaagtgcttgcatttctgcaaataatgactgcctgaaaattcccaaattacattcactaactctttgcagatttaaaataaagaagcttagtttgtgttaatttttttctgtatttattgcaagcacagagatattaagtagagtagacagaaaactgtggctggtagaaatgtccttatatagaaagctcatatgtagcatagctattagggctaagtattgaaaaatgaaatggcatgattgtgtttcaacctaattagtgttttataatgttttatctcagttatgtgagaatcttacatccaagcattttgatgagatagcaacaattacatcttactttctgtcttgtctaagggttttgattctataccagtgtgcatttataatattcataatcttagtcttttgaatacacagcataagacagactgtaatgatggacaaggaaggatgttgactattaaatcagtgttattaaattagtaatgcatgagcttttacaaaggcaaagaagggggaaattccatagaaaccaggtggggctttcagaaacattttgtttaggtttgacagattgctttggaaaaaaatctgttacaggtgtggggtacacttgggagagtagaatgggttggagacagagatgagagaaatcagcaaataataacctgagagcgtcctcagagcacatctgctcgtggggtgttaggttaatgagatgctgtcaacagagcacgtggaatgatgtcctgacagtttggcaaggagtagttgttacaaggtaaatattgtcactgccatcccaggggacacgggggagagggtgccataacagcaacagatatgtaagcaaatttcagatggacgggagtgaagagaagagattggagcccaagatcaacttcctgtttcccagtctctacatcaggtcccaccggtgtcaacgtctctgtcttggctgcaggttgagctgcataagtagagctgggggagcaagggggttacagaaagcacatcggagattggggatctcagacagtagagcatgtgtgtgactgcagagcaggaaataggcagcaggcatgtgtccgtctaccatgtcagcagaagcaaggcagcaaaaatgtcgtttgtgcaccacacaggtggaagtgggaacagccttctctcccctgggtctgggcttctctggtgatgagatcttgacacagaggggcacgactcttgagaggtaaagccccaccataaaatgataaattcatatcacctgcactcggaccactgaggatgcaggacagagttccaggaaagagaggcagggaatctttaagatggaagcatatctggaaatcatctaacaccatttgactgactacacaaggaaagcccaggggagcccttcagcctctaaatgaagcagacctaacaaatgcgaggctgcaaagcacagatctccaggctttgtggagcctggtgcctgcacacagatgcacgcatctctcttgaaaaggatttctgagtcagcagtaggagcaagatggatcctcagtcgtaggatgcgagtgtgtggctttttagaaggagggcaagcatgagaattgggggagcataggaccctgtcatgagcctgagttggatgattagtttgggtgaattatctcacaacaactttaggaataaggttaaagtctagattgaggttggcacaatcactatctcaagcttatcaaagacaaagattaggagctgttcaaactaaagacagagggatgaagtagatgacagtattgttcctggtgttgacattcatggttatcagtcatgcaatgtactgatatttgcatctagatgaagggtcttcatggcggtttttccattattcttgcagctattgcttaagtcttaaggaactttggtataaaatttaaaaaatagaaacaaggttctacgtattcctatagtatcatcatttggggcagggaaggcaatcatgaagccgtctggaaaatttgggccagagatggacctctgttaacacgggccacactttcccaccctgggccctactacaagcggcttgagagccacagagctgtcatggcaagggccagcagaggcatgggctggtcttcctccagttccaatgaatggtgaggtgtcacccaggctcttggaagtgtcttgagatcaactgtcttgttcacaggtgggttacaatgtcagtttagaaaatagtgtcctccattcacaatgatggcacaaagggatccaagggagatgttgcctctcagataaacactccaaggcaccatctccctccactgtagatggaaactccctcttaactgccaggaattatgtggaatctgttgatgctagggccatctccagccatgccaactgacccttcctagaagactagtcagtggagaactttttatcccaagatagaattatcaattttaaatctagagggaggatttttcttcacatattaagtgtaattcctcctcacaaacatttttgcttaggaaaataagattcttccaggtgatttcaatccactgggttccataagcatttatgggtaccattgtgtactacgcaccatgctaggctgagagatgctgagattagtaaagctgttttgtcctcaaggatctcatggtctggttaaggaccaagaaatgagaaaggcacaagagcaaggaccaccagtgggtttatagatagatgttgactttattggacctgggtgtaggaagaaggagtctaatgagcctgcacagaaagcccagacttggagaaggctgaggagtgagaagcagctgtgtttggcaggaggccatgaacaaatcagcccgaggcagggctccaagacaagtgtggaaatgaagtccaattttactgtctgaattttcttttatagaggaccagcttctaacatcttagaaagaataaattcctaaaaatatcttcccattaaatataataagacttattatggaaaattaatagaaatatgcaaaatattaagggaaagagtttccacttggtgggtaaggattggcactgctgcttggtattgctttggttttggttatttgtttgtttgagagacgagatctctctgagtcgcccaggttggcctagaattcactatgtagtgtaggccagccttgaactcacatcagtcttcagcttcctaagtgtttggatacaggcataagtcaccatactccactgagattggctttgaaaaatcttagcacctgtctttaggtgtgtcagagagatttatttttttccaaggcataaatcctcaggtcagaactaacctgatggttctcacagatggccacagaattcaaccttaattaactgcattaaatgactgttgatcttattttctcattccacacagatgtactcagtagcaagctgtgtgcaaggtcctgtgctagacagtccacaagttacttgtaaaaatggataaaacacccagttttaagtgcatagttttgcctttttgtatatcaaggggagaacccagcgggccgcaaacatctgggacagagtaaaggtgtggttagatcatctggcactggtgatagtttgcagaatgagcatttgtgccaaatcacagaatatcataccagactttatttatgagttagtctgacgagtcacatgataggaagaacactgtcaaatgttccctgaagatgtcaattttaatgcattcttaaaagaaaagctgggggatgctagagaaacatcttagcatgatttgctctgttgtctgagcagagtttgggtcttagcactcacatagggtggtacacaaatgcctatgactccagctccaagggatttaggatcctcttctggcctctgtgggcatctacacacatacatacacacacacacacacacacacacacacacacacacacacacacaccatgcacactctcacacacacgggcgctcgtgcacatacacagaacacacgttaaatagaataaaataatttttaaaagaagaaagccagggacttaggaaatggtttggccagcagagtgacagccacacaagcctgaagacctgactgtggatgtccagagcccatgtagaaagccaggtgcagctggggattaataaatatttagtggcttgctcagtatgaactccctgagcatattttgtctgcttgatagaccagtattatttactgctgcaagacacactgtggcaggataagactaccttgcacccttatagagtttgtgttttcatggagacctgagagtcaacacacatgtagtcggacattaaaggcactcaccctgtactgctctgggagagctgtcaaatcaaggcagatggtggctaggcttgcttttgctaggcagagcacatatataagccaatatcaaaaggaggctgtccattctgacaatgaggacggcgagctctttcttcccaatctttaaaaaatcgcttaaaatcttatttagttaacatgtgtgggtgttctgtctgcacatatgtccatgtaccgtgtacatagttggtgcctgtggagtccagaagagggtgttggatcccctaggactagagttgcagacagttgtgagccactattggattgttgggaattgaacccaggtcctctggaagagcagcaagtgctcttaatctctgagccagctctatggctccatcactgtttgtttggaagctgttatggcaacaaaagtgttgctacaataaaacacctgattctgggtgtttcataaggcaaacgtttatataattcccggttttggatgctggaagtccatgattgggtgtcatcatctgtccagtccaggtggggaccctccttggttccatcacaattttatggggaagctgcaagggatgtggctgtgtggagaaggggccaggcgagcaggggggctgcactttgcatcatgctctcccgggagtgtctggtgccgcccccccgcaaccccgacaatgccaatcccttctaaagacagagctctgtaatccggtttcctgctgcaggtaccacatctaaagactccattgccttagtcatatttcacaaggaccacgcttgaagtctggagcctctggggaaacagtcacagcacacaccgcacctaaaccacagtagagaacatgatgcagagccaggatccaagcacaggatctaaattagtgttttttttttttcatggattgtttgatggtagttgaaatgtttgacaaattacaaaaatctttgtaatgtttcaatgcattggcccccagtgaatacaacatttattaaaggatgtgtctgggtcacctcagggttttgatgcggatccaaagcttttctcatgaaagcactcaaggtgttttgtgtcagaagtcagttttagggtagaaagaagtggctgaaagaatgagcacccgtatggggttttggcccaggaggctggggagaaatctccagtttgttgttttcttcttgagtcctggtacccttcagtggaggcaataatgtggtgcccaaagttccttctgcagatgcagcacacgccacgcttgagaagggctgtcatcgattgtctcatccgtacacatgacagaattgcacttctttttcgagggaaaattttaaaacctcctttgtgagaaatttctaaggaacttgtttttttttaagtttatttaaaaatcattggagatttttcttatgcttctatgtgtgtgtgcatgagtgcatatatgtgtgtctgtgtacatgactgcatgtgtgtatagcttcatgtgtgtgcaagactgcattgtgcatgcatgtgtgtgtatgtgtgcatgactgcatgtgtgagtgtgcctgtgtgtgtatgtgcatgactacatgtgtgcatgtgtatgtgcatgactgcatgtgtgtatgtgtatatgtgcatgactgcatgtgtgtatgtgtatatgtgcatgactgcatgtgtgtgtgtgtgcatgactgcatgtgtgcatgtgtatatgtgcatgattgcatgtgtgtgcatgactgcatatgtatgttatatatgtgcacgactgcatatgtatgttgtgtatgtgcacatgcatgtgtgcatgcgtgtgtgtgcatgactgtgtgtgtgcatatgtatacatgcatgattgcatgaatatgtgtgtgtgcatgactgcacgtgtgcatgcatgtgcatgactgcatgtgtgcgtgcgtgtgcatgactgcatgtgtgcatgtgtgtgcaggcacacacgcatttttgtgcatgggtatgtgtatataggtgagtgtgtgcgtgtctgtggaaggcagaggtcaggacatcactcaccttgtattttgagacaaggtccctcaatggcctggaagtcacccatcccgctagactggccagcaagccccagggctctgcctgtcactgcagccttagcaccaccatccaaatgttaggcttaattcctgggggtctggagatcaaatccacatcctcatgctcatgaggcaagctcttccctggctggctatctgcccagctccatatttcctgatgattaaatattgttggaacttgagtcagtcttcaagtgtgtccattcatattcctacactcatatgaagactcaggtgttttaaaatataaaaatacatgtgcgtgtgttttaacacttaaagctttctcagatgtagtcacatgtgtgtgggttttaacacccaaagcatatctctatttcataaaatgtaaggttctataaactgggttcttttatttttgtttttttacatttgttatttattctgctgtctctttcctgtgtatgtgtctgtgtggaggtgagagttggctctcttcctctgctgtgtggtttctggggatcaaacccaagtcattgagcctggcagcaagaaccttcatctgctgagccatcttgctggcctgaactagattcttttgaggactccataatgggataatttgattctaatacaacaagggaatgatgaaggactatacctgatttcccacaatcatcaatcatcaatttgacttgaagttcccaagtgaagtacatttatcaaaagtatttcataaatcactcccgcaggagagaaagtagagttctcagactcgaagtgaagaatggtgactgctcttggactttcttgttgggacctccagctcctcaatgacactgaaacttactagtcaagaaagctttcctgtggtagaaagttgactgggttattctgagatttgtgcaccatggctttgtttgcatatgaagcacagaagccaaaactttggtgttttctatctgtgttttcttggtgacaagtaatccctgctcctttttccaggtacgctttccccgttgttctcggttctcctttggatagcagtagcgatctgcacatctatgctgtttttcttctccaagcctgtgggtatccggccatttcttgtgtctatcatgctcagatcaatatacaccatcggtctggggccaacactaatacttcttggtgctgctaatgtaagtacattgcttaactttgtatcttatggaattcagatgtattgagtgtaaatatggttaactatgcttttatttatgtgtatgcagtgaattctggtttgatataaatttatgttaactaaagtatcatttttacttgctttaatttagagagagagagagagagagagagagagagagaacaaaaagatgagtaacacattgataggtttaagtagcccttacagtgtgacccagttcggctgtccctttcatcaggtttaatgtcctcccagtaccatatctgccattactgaaaaaaatagcccagctactgttaacaactgaaagtgggttctaagtcatcccaaaagattgaattatgttcaatagaatttaagaaatacctcctatcaaatggcttgtttgggggagaaaagtgtgctaggcaaaaaatgaggtccaaaattgggctccttttatatgagaaaatcctataaacttataaaaggcctgggtgagattcttttcgccaaactttagtatattagaacaagaaaatgcttttgacaatgttagttttaagtgtggaatgaacaaactggaagtatcatgccaagaagcaaatgaaagatttgtagatgtaatttaaacaaaacaaacaaacaaacaaaaaacttgaatggactctgggccaatttcaggcaaggaatatctgtaaatggatatgaagaaaaggtaaatcatcaaactgatgaaataacaaatggtcagaaatcacataaatgctattgtagctacataattaattccgaaagcactgcctgtaactattgtcaggttcctaactcaatgttcagtactctggtgttatctcctatattaccttacatacttattaaggatagtgattgatcatgaaatcctgggacatcacagggagtctataaatattttggaataagtagctaatgagcaagtggatggatctgtggccactatgtattgaaaataaatgagctaaccaacttttaaagattgccaagatgagacaatatatagtcacttctatgttttcagtgtttctgaccttgattttattacaactcttcaatgttggacagcattccacagttcccagttgttagaatattaaaaaaaaaaaagaaaattttcagtttccatcagtgaagtaaagtgtgagcagaggcttttgaaagttaccagatgcccccttctctgggtttcttagggcttagatatcacattaatgcatgaacctggtccttgctcagccccatctccgtgttcctgtgtgatctggcccttgttctcccctgtctcaatggggcaatgcaattcattccttctggctcactccaccctgtctttgacatctgaacattcagaggcgattccatgatctgagttcgttttgtctttgctttgaaaataagctgacgttgtcaaatcatcaaccaaggtaattataggatcatcacaaagtgtataaacgtgtctatacctctgtgttgggctcattttgtgtctctagaaaacatgttcagcatgaaattgtattatttgaggaatcagatgttattcataaactgatcattgactaaatgagaaaaatccaagtttaagaaagtgaagaatagctaagcagagttgtcccccaaaataacaaacattctctgcacctgttatgtaatatgatgggcatttagagcaccaagaggtaggcaatgtgcagcttgccatctagaatttatgtgccactttctgtctctttctttctgtttccttttaaatttctggaccaagacgatgtagacagaggtaaggaaaacatttgaatgtttggggtgggcgtgaaccaaaaacatctggtgttcttttcctgtctcttgtaggacactataaagtgataacttccatgtgctttggtgaaaatcatctcaccataaaaaaaaatctctaccaaagccaagtttttttttttaactgcttcacgagaaagtattatgcatgtagacatgtctgtattgctaattccatgaattttccagtattccaatagcataaaacatgttactcaacaagacactaccaccagcctagggtcatctgactaaagaaaataatctatgtcgatttgaggcaaatttaatgaaattattataatttgatactacttcagatgttaatagaaaagtttatatttataatttaaagttgtgtttgctaccaaaagaataataaaattattttagtgaattactatatactttctcttcacataaattcgttacacaagtttcttagtttatctttactaatgggacaggaaaaataaagtaaaacatgaatcctatactaatgtaccttggtattaactacatattaataataatatgaattaatatgttaattaatttaatttgtacatagacatttgcattgtatagcaatgagaagctgtcattgctgaaataatagatatcagaaaaaccagaagaaaacattagcctgacagtttagccataacaagaggcaggatttgagacatcagatataaatcagccaatgtctgatttcatccttcttgtcagttggagtacggtatggacaactggtctaccctcatctggatgctgagatctgttgagaatcttggtatggaagatccagaaaagaacagtaactgttatattgatacactggtgataacatctaccatttaccaagtatcccctgtgcagatcattaatgaatcaatcagaaagtgttgccatatgatgtgtctgtgtcttagcgcatacagtaacttgtctgtagactctgtccttcataatgttaagcaaatatgaaaagtctcttttacaagaaaggaaatataatagaaggaatacctcagaatttatcagtttctagtttattatgctaaaatcgaattcgtttgtaaagtttgaagtttgtccacatttcaggtagattttcctgtcacagttgtctcagaaaactcagtaattttgagtgctgcaaagtatatcttacacagttttcttctcgtgcacagtgtggcctctttagctaatgttggtacaaattaacattctgaacaatacagaggcacattctataaatgcttaatgttgttcacatcactgaatatttttgcaaacctcatttatacagatgtagtatttcctgtttttaaggagattactgattcattagatggctgttatatcctcattaatcactccatttatctgtgtggcttagattatttgtagtaaagaaaagcatagtaaattatcagtaaagattttccttctgatgctaggaactgaaccccgagcctcacacatactaggcaagtactctaccactgagccacaccccaatccccacagtgaaataccttttaacattttctaaagagatctacttacactgttgtcttagttaggattttattgctgtgaagagacaccatgaccatggcagctcttataaaggaaaacatttaattgggggctggcttacagttcagaggtttagtccattatcatcatggcaggaagcctggtggcatgcagggagacatggggctgaagaagtagctgagagtgaatgtcacactagacctggcttgagcatttgagacctcaaagcaaacccccttagtgacatacctcccccaacaaagccacacctactccaacatggccactcctccatgccctgtgagcctgtgggggctatatctattcaaataaccgcactttacccccttctaataatggctggggacctgtgattcacttagtggtgctagcctttcttacggttattttaacgtgacacggtagagtgtgttctccccactttgcaagagggaaaagcaaataaggctttggtatcgagccagactattgacagttcccacaggctcagctgaatgaatggtgttctgagcggtgtgtgtgtagtttcatgggtgaccacatgacacgttagtctataggattgtgtcctgtcatacagtcactaaacacacaagttcagttcatgatctgaaactttcccttcatattatctctctctttcaaatacacacacggtgttttgtttaatatggtcaccgggtaccactatttctgcctttcagttgtaaaaaaccaaagcctctctgaggttgtgttgggtgtcataagtgatgctgctcacatcgtctgtgtttattatactgttctgctggcagtttcaaagattcccagggtggtatttgactgtgtgtaaatttttatttacatagtgaccttaagattttatcctgcctgaggtgtaacccacatacctggagatcattgaattaaatcatcttatgttttaccttccatcagcagactgtctgttgtttttccacttgacaatttattcttggaaaataggtcatgttttcccatagtaatagcacaaatgaggattacatattcttctcaggaagagagtcttgaataagaccaaaggaataacactatcgccaacacttagcagtggtcagtttctgtgaccatataaaataacaaaaagatgtcacaaaaattatggggccaggaggcgtctttaatggcttcagtctggggctggagataaggctcagtgttaagaacatttgctgtttttgtttttctgaagacccaggtcagctcccagcaccaaagtcagacagctcaaaaccatctcaaatggctcgtcctcacctgccccaaaaggtactgcacacacatgggtgacacacacattcatataaataaataacaagataaattctgagtaacgattaccttctaggcacatattatagacgtgaacaaagtcctctagaaacagagggatgtgtcaagaatgaagtcagtgacttctgtctttcacttcaccacatcactgaaagtcctgcaaagacatgtctaccacttgtgagcatacatgaagatatcacactgccgtgtgattcaccagggtgcaatcaatactcattcttcactagacactaactcataagcaaacattaatgtcacccttgctgtgacaaggggagctcttggtaaacaggttggttagcatgctgatttctgtgagacccagagaactgtgtggagctgtttctccacccttccttcttcactattactcaagtcatccaccaaagtgacactgtgggcaactttgaggaataaatagaaaaagtgaaacaaaatgtgtggtgctgttggcatctgtgctgctgtttcaggactgcttccagcagctcagaagagcagggccctgtagccacctcagcccaccatcacgcatcgcccacggggatgcttgccacagaactgattggctgcagcatcctcatgaggccgacatagaaagaccggctccatgtcaatgaagtcatgacacaagcaggaagaaggtgatctcggctctttattcctccaccaagtcccagctctcatggaaagtgccacacacaaaaaaaatttacaaatttcttcatgccacagaaactggactctcagttctttcctgccctttattcttgcattcatttgtccttggcataaactccttaaacacaaggaccgcttccgcctctgaactctgtgtgaacccatggcaaagccaccacacccgtcaactcattccacttccagatgtctctagaacaacagttctcagcctgagggtcacaacccctttgggggtcgactggccttttcacaggggtcacaatatcctgtatatcagatatttacatttgctcataacagtacagtagcaaaattatagctatgaagtagcaaggaaagtaattttatgtttgggggtccccacaacataaggaactgtattcaagtgttgcaacgttaggaaggttgagaaccactgccctagagaacagaagcatatgcaccccgttacatacaagtcaagggtcgtgcagcgccacccgggtaaacaagcaaagcaaatctctctttatttttcacgttaacatgaccgagccctgctcaggcagaaatgcatcttgtcttttacactttgtaaccaaaatttattgatcattttgagaattcagtttagtctgttcctccccagtatatctgcttcataaacagtttccctgtgtgttttttgtaactcatcgtagaaaatgaggaaatgacacagaaagcatatgtctgtgtcatacaattacccttgtgagggggtctttattctacttttgtataaatccctctctctatcacatcgatgaacctgggtgggcaagtccaggtaagttggtaagttttgtaattttggacagggtttctcaaaagcaattcagaataacggctggatgttgctttgccagacattcatctcacccttgttgtgcatccagcttgtggccagacacaggacctttgtgtgtattcattgcttgggttttgagcagttttctttcctgctcttagagagccactctgaagtctccgtcgtgtctcagtgctactgagtgacaacataaaccgcctaacagtgaaataaggctcctgcttgattgacagctgctgaagttgttgaaagtgggtggaaggtgtttgagattattactggttattgagagggtggacagctagttggggacatggaggagagagtctgcctttagtggctgtgttgttgttctgactagaccttcataacatgcaataattaccagtttttcattttatctgtatggattcagacttcaggatgtcggtggaaaagagtttgtattctctcaagtttgataacatgtatgtgtgtgtatatgtatgtaatacatgtgtgtgtatgatatacataatcagtgttgcaaagagcgtcctattttcctaaaggcatacatataaatacacagtcataagtatctaaggaacatttgaagagtcattgtagtaattgctctggccatgtcatgtcatctgggcttctgtgaggtaaaacctcctcacagcaggttttcagaaaccatcaaggcttcccatggaaagaactaggttgtccaagagtaaggaaaagccagatttacactcatccatgttggtgacagagctagggtctcattctctgtccctgtagctacagagtgagccagttctgtgttgttcacatgtgcattggcagactgcttgaaaaacaacccaggagggctctgagaacggaaaccacaacttaggaatactcctctttcggtgtcttgttctgcggatactgtgaagcactaaaatcccactttctcctccgtttagctatgtaataaaatcgtgttcctggtgagttttgtgggaaatcgaggcacattcacccgaggttatcgagcggtcatcctggacatggcctttctctaccatgtggcgtacgtcctggtttgcatgctcggcctctttgtccacgagttcttctacagcttcctggtgagtacagccatagggacaattgccgctgggcacgggatgcagcaccgtacaccttagactcccagttggtttcttttggtttggtttattgttgtttgttttatttatttgttttttagcagggcacaaattatgttatttttggtatttcctaggagaagtgtgtgtgtggggtcttttctctgggaagtacataggtgatggaattctattctttgctgagaagtaagaaacttccttgactcttctcttggcccaggctttgggttttcagccaagtaatatttccttaattcactgattatccagatgcaaagggacaaataaggatgtatatcttatctataatgtcaaagttacattagtcattacggtagtatgtaagcaaaatgagaaggaacaaaagccatcctagcaaaagagcaagctgtttaaagtatagattagcttaggtcatcatcattagtttatgatttagctcccattaccattgttagcttatgtcatctgggctaagcttatctatgtatatttaaatctttagacagttccccccccctgcccccggattccttttttttttttttttttttttgttctaagatgacttgcttcgctgtgtagcccaggctggcctctaactcacagtttcccacctcagcctctgtgctggggaggtgcctgtgtgcctacacacaactgtacatccttcttaaagatgcctctcattcttaaatgccattttcctttctctgtttacactgttttatagtcatgaatgggggaaaggagttggtgtaaaaacatggtaagcttgaatctgtgagcgatatttgagtgtgcacatataagtatgtggcagtgcaggcaaagtcagacctgcttgggagtcacccctcacccctcacccctcaccccacacccctcaccttgtttgaggcagagtttctcatttcatcattatgaatgccacctactctggcctctgatgagttaaaataaaacctcctttatgtgaaccagagtggtgaaaaagttgaagaaaccagaacattgacaatctagaggttgagtttgcattaattcatctttattgaagaatattgactttgtttctaacaatagctgtacttcccaagagataaaaagataacaaggtagtgatttttttttttttaagaatttgacacatcaaatgccagtgtcttaaagacaggttctgcatagcagtgattatcaaggctgtgattgattacagtggaaattaatggtgtaactctcgcacacagcagaccaggggattttcaaaggacacacacacctgacagattgttccaggccagctagattgtagttcttatccccagataagaacacaaaccccaagtctccaggtttgaagatcggattcatttccaaacatttttggacatttctgaaaatgaatataattttatttcttttaagtgcctctgtataataaaacatgcactcgctaattcataatttcagctttataatgcagcaatgtgtaaaacggttcccagcattggctgcaggcagcagacatgtgcttgagttctcaattcgtgtttagatttcctgctattaaagacagagtggatagtaacctgcaaatagagttcttaattggtctaaataataaaaagccagagtcagatatagagagaaatgctgagagatcacagagaaggaacaagccaccgccacaccttacctctttagcgtctcagaagaccagagagtgagttcctgtttctccctgcttatatcctgtttccatgcagctacctcacttcctgtctgtctgtacagacctccagacctctatggttagctagtggcaagctccactctctgactcccagacaggctttatttgttcaagtaagatatcaccacagtaaccctttagagggaaggaattgacaaaacagttacctttttttttgtggttctacttgcaaaaggataagctaacacagattttttatcctcatttatgtgttattttaataacgaagagtacctgcatttcccaaatattttaaattcaaacatttttctgtcaccaggctcacaaaattgttctcctcatttcgttttgagtccctcaattgaacgataaatttaatgactttttcaaatgtccataagccacatgtgcctgatattttaaatgccctaaattcaatggcggtgtgtcttagcaagcggtgtgacactgttgacgaagccagctgatgctcgtggatgctgctagagcctccttcattgaaactgtgcctccttgtgttctggatcaactgttggcgttcatttaaaaatgttgtttgtttgaaggctattttttaatttttgtctctgtagctctttgatttggtgtacagagaagagaccctgctgaacgtcatcaaaagcgtcactcgcaatggccgctccatcatcctgaccgcggtcttggctctcatcctggtctacctgttctccatcattggcttccttttcctgaaggatgacttcaccatggaagtggacagactgaaaataaaaacaccagtcccaggtagccactccaccctccaagctccccctaacagttctgacttgtacacaccttgtttgtgggatttcagacacactgaaataggtaaaaattttattttcacccttttaagatgtggtcttgtttaccagtgctgtggtttaagggtgaaatgtcctcctagccccgtgcgtttgaacatctggtccctatgtggtggcactgtttcagctggtggagcctctttggaggaagtggtgagccttgggttggacagtctggccttacttcctgtctgccctctgcctcctgacagctaacacagtgtgaccagctgccttggctgccgccaggtcgggctgtatctctttgaaccattagccaaaataaactgttcattccttcctcaatttgctcgctgttaggtatttgatcctagcaatgattaaagtaataatggaacttctaggagttgagaatttgcaatactgcagcctgtatgctgtcagtgtgggttgggaaatacacatctgcactccatcctacagggtttcctaatgctgaccatattgcaggaggcagcagcggcttcactgtggggaattcctaaattctttctttttgcctcttcttcccatttccccaaagaacagtatccagcacccgagagccaccactcagccattttccacatgcattgctttgtgtttaaaatgataaatgcgatttggaaaccattagggagggagaagtgtgttttggaagacgtgcttagaggctgtggctaaaagaccccactcctcggcgagtgactgctggggccccgcatgatgtttgccactggacacttggacatcacctcgtgttctcgctgagaagccccggcatgaggagctagcctattattttagacttcttatctactctgtttgctttctcacctctagtacacaccctttgctgggttaaattccttagttaacctttcccccaaccctgctttactctgtagaaaccacggttctgtgatgtgctgttttcttggttccactaactactgtttatagagacaggaaatccccaaaagacatgctttctcctcaaaccacagactttaaagcactttaattagtggagacatatgcaatatcctttcttgcctttaacagataattctttctaaattccatttatttatttatttatttatttatttatttaatagtctggaccagtttcccctccctcctcttctctcatcccctcccctatttcctctctcccacccactcctccccgtttctgttcagaaaggggcaggcctcccgtgggtatcgacaaagcatggcagatcaagttgccctaagacgaagcacctccccttgtgtttaggctgggcaaggcaacctggcatgaggtggaggggaaaaatgtgggaagagctgactagaaggtgcttttagaggtcaggtgagacccccacgggaaccccacacacccacaggggtgacagatagttcataactatggaattgacaatgcatagtaaggccttccataagcttatgggacgaggaaacggtgtttagatccattcatcagtgagtcccatgactcacacacgtgacagaaacaccggcttcaccggggacttcaactccacaccaaatatctgtctgcacgttcaggaccgtgggatgttttgttgttacttcaggtgcgttttctagagtttccacaggcattgccagcagctttccattcactgttgtaataataataataataataataataataataataataataataaaaaggccaaagaaaataatttcaacacaaggaaatgatttattttggcagcttttgttttcagttaatgtcacttaggcctatggcaagacagaactctgtggttaggcaaagattcttacccggtgttggctttgaggtggggggtggggtggggtgggggtggttctcaatatcgcttcaacggtgcatccccagtgaccccgccgtcactaggcctcccaaaagatcagataaactcctgagctggtgaccagacactcagtgtatagccctagacggacactgaagatgaagcccatcccagcagggttcaggtgtgtgaagaaggaaaggcctttctatcagtcccccagtgctccactctttctaaactgagatcagagagcctggagttataatcactggctagattagaggcctggccacagttcattcagtattgagaacacgtgagacagagacagaagaagcgctaaagcttccagaacaaacctacacggtaattactgttttctgagttctgtggtaaatattttctgttgtttggggaggaagttggtgctaatttatgaatgcactttctttagaaatagaaaaaaatacaacgtaagaaatgttaaagctgaaatttcaagctctgtctttactgaaaatgtgtaggagccagtctctctctctctctctctccttctctcccttccccccctctcactccctcacacacacacaaacttttgtaaatactatgaaagtgccgaatgtggagacaactacactaccttaagtctgctttccgttgccacaacagattacttaagacatggtagtttataaagaatagaggttcatttagttcatggttcctgctggaggaatctgcttgatgtctgaagaggctgtttttgtgaaagataacaacatagggtaccccaccacgaggagaggcagaccaggctttaaaatgaatccactatagagataaccagtaatccatggtgcgcgttaatccaaccccgaggagagagacgccatgtctcatcacctctcagtactttacagccaggttcagtttcagtgtgtgccttggcggaagtatctggcctacagcagggtctcagtgcatgtcgtctttattcttttcgttttgagcactgtcactcacaaagctgaccatgggtgaaatcattgaggctaacacactcaggtagtgagtgacattggatgcagttcttcaagcaggtgtgaagccatcagaaaccccacagatgggagcaagtggggagttggaaagtcagagcttgacgggcagggcctgggagtgctggggagggcggaagacacatgccttgcaggcatcattggagatttctgagaatgtggatgccacctctggccccaagatctgctgcttagtggataggaagcagccacacaggcctgggcagagcagtgccattgggaagtactaggaaggaaggtcctcctgacaagtagacggtgtttctcgtacctgcccactcctcattcgcatctacccagagtgcagaggttgcccttgtggctttataacctaaggcctccctccactgttccagccaaagctctgattctaaggatctgaaccatccgttgggtgcttggtggaaagttctgggctgggggtttgcatggctcagcctgctctgccctctgctcccctttgatattatagattgcaccttggtgacccctgggctccctgcttcatatctatgttcataagcccggggttccttcagggaaatccttccccaagtaggtacttctttcctgtctaggatccatctccctcctctctcctactctgctaatttgtgttaacctttcctttactcgtccatcagctcccgttacgcctctgcctcttgattcccgtcagttctccaaagcctggagtctgagccatgggagcccagtgtgacacgttgagtactgactgtcatcggggttcactcagaactccgtctccatgacactccttcccaaagctgtcacagcacccgtgtggccacctgggcctccccagcccacccactcttcacatctcctcccaatatcagctcccatttgtaaatctacttcttttggtcctctcagctatgagtcaaactttcaggttcaactttgcttcatacaagtgcaaagattattatctctgcaccatgtgggccagggaaaccagtgggaagccagcagaaagaggggttcctgggggctcggggaaggaaagttagttcccaaacatggttctgaaaaaaagtcttctatcctccggctatttgaagcctttattctctgagtcccttacctcattgtgaggactgcctacccaaggtccttgcttcagccacagggaccagtgacttgagcctgcattgggaggaagctgtcctagcagcccaagtcagaaccctgaatgcatgtggctagagaaatagcagtattcatggtggcttaggtcaacaatatcattagtactttatcacagcccctaaaagaaaacaattagatgattggagctttttgcacattggtgactaatctgtcctctgtaacattgctttaaaacaggcaaacaaacgtgtgctcagagctccaggctaactcaccaaaaggctttaggatgcagcgtggtcaaagcacaaatatctttaaactcggatgcctctgtggttgtctgtctgtcatataatacctgcctctctacagttctctgctctgtgttctcccaggtaatcacggggctcccaccatgaccctaccttccatgatggggacctgtcagaaggagaactgttcacccacgatcccctcttccgacgcaggtgtgtactgacaacccaggtctgtactagcccctctaaggagagtggatcttggcacttcataatgtgttgaaacagagaacaaaaggtaaaggaccgaaataatccaagctagagaaaggattccgcacttgttattctgagctgtcttggttctcacagtgtttctgcttacccaaacctggcagattcagcatgtggaaatgtgctgctcccaaacagcagcccacactaaaggatccgcttctggctacttggctgccaacaaggggtgtgggaaagcaggggttctactctagagacctggctgtaaacctggccttgccactttgctggcttacggtacacaggcttccagaaccatgtttggatagcttataaggacagaaaaatgaatgaacaaaatccctctccccctttcgggagcaagcagatgtctaaaaatagctttagctctaaaccattcccttaagatgtgacagcagtctgggaatatggcatgtatgatgttttataaattatagaaaaaatagtggtgtatttcataaagcagtaaacacgacggattgtgtgtgtgtgtgtgtgtgtgtgtgtgtaggtgagtgtgtgtgagaatgtgtgtgtgtgagtgagtgtgtgtgtgtgtgtgtgtgtgtgagaatgtttgtgtgtgtgtgtgagtgagagtgtgtgagtgagagtgtgtgtgtgagtgtgtgtgtaggtgagtgtgtgtgagtgtgtgtgtgagtgagagtgtgtgtgtgagtgtgtgtgtgagtgagagtgtgtgagtgagagtgtgtgtgtgtgtgagtgtgtgtgtaggtgagtgtgtgagtgtgtgtgtgagtgtgagtgtgtgtgtgtgtgtgtgagtgtgtgtggtgagcgcagggccacattcatgttatgcaagtgctctacccgggagccacccccaccccttgtggactctagatctttgtgtcactctggagctgtcatagctaaggaagcttggagtccattaaatggcaaaatgaactcagagcagatgaaggaagtgacatgaaagacagtggaaggaaggagcgtcaagttaccttgctttcttgagatgttggactgttggtgggagggcacagatggccccctccctgactaaatctccactttgtgacctagagagagaatcaagcgcttgtatttatcccaggcagtgtccaacagtgtgggcacttgagatgttcccagcaaggtttgcctgacccccagtcaaaactcacacaagagccaggtcttctcggcttacatggcatcaccaagtgtccactctctacagtcatattacgtgtgtctgttggtttaaacacctcctatttctcaggcttccccacagatctcagaggaggttctggacttcaaactcctactcaagctgctctcactgtgggtggcgagacctctctaagtcacatcatacatgctctttttaagatttctttttatttcttttaatggtatgtgtgtataagcacctacaggggccagagagtgtcacgcccccttgacctggagttacaggcagctgtgaactctctgccgagagtgagagtgtggtgggagacgactcagatcctctgcaacagcagtgtgtggccttaacccctgagctgtctctcaagctcatctcacgctattgacctggcttccaggtttcactgccctccctttccctaattcatgtgacctgacgtgccacttggccttgcatggctcttgacctaagaatggttctgccgtttctaacttattagagaaagatttaccatacaaaatgggcgtggcccagagaccctgagaagtttcatctggatcctcacagattaaaacagaatccaaccactgctctagatacttccacaggagatctaggaatgttacaaaggaatttcagggcctggaaacactctcagatgctttatgaaattcttcagctacctagaaatttgtcacaaatgggactgggtgggtgtctcaatcagtgaagtatttactgtataagtgagaggttatgagttggattcccaggacacatacacacactcacagacacacacagacacacacacacacacacacacacactcatagacacatactcacacacacacacacactcacagacacacacacacacacatatacacacagacacacactcacagacacactccaaacacacacagacatactccaaacacaaacagacacactccaaacacacacagacacacacatcacacacacatcacacacacagacacatacatacacacacacagataacacacatcacacacacacacacagataacacacacacacacacacagataacacacatcacacacacacacacacacacacacacacacacacacacctgggcattgcacttgtaatctcaaaactggggaggagaggacaggaggatccccagggctcaatggccagccagtctagctaggagcaattgagaaaggcaacaaaggttgacctctggctgccacattcatgggcatgtacatgcaccctatcagttaatttccctctctatctcacacacgcatgctcacacacacacacacacacacacacacacacacacccacacacacacagagagagagagagagagagagagagctcataaataaactatcattcaatttatgtactttctaagttttttttttaattctttgtgaaagccacaccccccccccggtcgtggggcacagtgcctgctcatccccagtataaggacggcttgtgccatccctgctccccccgacagcatcctgtcaaggacccacttgagcatcttctgttagcataaagtcacttgtcagcagttttcagagtctgtctccatcttaagtccctgactacagatgtctctccttttcctaaggacaaatagggactgttcttcacccctgtgcagtgctccccccccccagtctctgtcctttggggtacaacagagctggtagcagtgtgtgggaatcttgtagagaaagctgccacagtagaggagagggctggcagagctgttccggagctggggtgagggtagggcagctttcccggtgaaggttttctcacagccatacctagagacactgagaagccacagcagagccatcgtgcatttgacgttcaagtgttaaaattgatttgattagaatttgggaagtctatggatttgacttttatttttataattgaagttttaattttttacagtaggctgtcactatttagccctggagttatgaaaactcgatatgtagatcagactggccttgaactcaccgaaatccacctgcttctgcctcctgagtgctggaattaaaggcgtgtgccaccaacacccctagtggatttgacctatacattttgcctatgtggataatttcagtaattaaaatgtgtaggtcttatcttcagggccttatttgctctaacttttggcagaatgtgtgcagctacagttatttgattggcaagcctatgagtttgatcttctgtgcttctttaaatgatgtctctgtgtgtttagccacgtaagtagagagaaagctgaagtctggcatttgttgtgcaacacatgtcacttaggcttaaaaatagcttttccctgtctagggctggggtgcagttctaactcgtgagctgtggtgagcatttttgagggccttggtctgctctcttggggccagcaggtgcacatcacagaatacccaggcacacggcacctgtgtaaaagccaggcaatggctggcaggcacagttggccctgggaagactcctggagatgcagatttggtcatttttccatcagccgaggattcacctgacaacttgcaacaaattcaacttgaaaaacactccaaaatgtttgtatttcatttacttcaagcctgctagaacctcaggtgaaaatacctaaatccccaccaaaagtgacttttccagaaaagccaagctttgttaagacaatattaaaagtctaatcatggctactctgtgagtcaatgccatttgcacattcaggagaataaaaagttcacatgtgtttaagcatttaagagaccaattttaatctcctggtatcctcctttaatagaaatggttggtggatagcagagcttgtcaaggtaacacatgctacattttggattcccattgggtatcagtcttttaaaacattttcctaattacaaaaaaaatttaagaacagcatttctctaatgattggattagagtcactaaagtttaagacgagaggacttgagttgccatcagatttccaagtgaatctcagctccgggctgctgtgtccacaaacagcaagtaatttaactaataaagcataaaaaggggacatcaataaatacttacgttcgagcatgtccagtatttttaagatgtattttttatttatgtattttgtgtttgtgtgagtatatgccaagccagaagagggcattggatcccctggggctagagttacaggtgttgtgagccaccccacatgagtgataggaactgaactctggtcctctggaagaccagcaagttctcttaaccactgactttccccagccagtgttcaatgtttttataatatatagactaacattccaagtgaaataatgtcttcagaacctgggggataggtcttttattcctttcctcaaatgaaacttttaatcatcatggattaagaaaaatgtttttctgatggtcagcttaagacagatagataagctcacatcactcaagtgtcagatttgtttcttgtattaaaacaaggccttttcataagatgtaacagccactgtgtgtgggtaattgataacttgtatttactgagcccttatgatgtaccaagcactgtgtgtgtgtgtgtgtgtgtgtgcgcgcgcgcgcgcgcgcgcgcgcgcgtgcgcgcacatgcatgcacaggtatgcccctgccatcccattgtacctgagggaatgtctgctaggcccgactgtgctggccaggcccttcatttgatatttattcagaggccactgccttcaggacacctaggctgctgtgtgtttgctcatctgctgacccactgccttcctcttggggaccataaggttccagtaggctggggcacttatacctctgtctccttttcctcacacaaagcctgtgttgtgtacagataagcttgtctcacaagtgaccacaaggtggcacttccctatgggagccctgaatgacttattgagagtggagtcatgtcaaacagtagacccttttaataagctcatagaccccagtgtgcctgtgtttgtagctcctattgagcaagatgatgggccaatgctggcactgacataacttgggcatcctcctgctactcaatttttatatttcacaaacttacgcaaccctgccaagtcacaactctttgcttagttcttgtcaattgcataatcgtaggcttcattatgacacttccatattggtatttaacgaacttggagcatatttaatcccaattaccctttctcgggtcccatctccttccccccactttcacagtcctaatagttccctaccctttgggctttcatgtcttctaagttatacatatcagacaaaacacaattcttgtctttgtgagtctggttccatccattttcttacaaataacataatgctgttcctgtttatgaatgaacctgttatatatacaaaccacattttctttctctgccggtcccttcatctgtgatgtatacagaatgtttctgtcctttggcttgtccacaggtttctctgtgatgggctgtctttgagtctttggaatctgagccagaaatggcatagttgagtcatgcactggctcaagctttgattgtttgagggacttccatgctcatttccatgcattggcccacattcccacatgtccaccagctgtatgtaagggtcatattcctacacacacacacacacacacacacacacacacacgcccttactaacggttgttggattttttgtttcttgtttttgtgtttgttttgttttggaatcttgatggtagccctctgatatgggtgagaagggacctcagtgtcgttgtgatttgtatttctcttgtggcccgtcatggtggtgacattttgcgtatgcttcttggcagccagtgcattttatttatttcaccgtggctaatcacatggtgtgatgtgtggatttccctaactcctgagacagcttcattccctgccacttccacgtgcccaccgaactggcacacgtgggtcttcagccggcatctgctatgctacaaccaggcagttaccgattaacaagtgcatgtatccagtgtcccacgaaactcgttactcatttgctctgattgaaagcccttcttttgcaaagtggcagtagctgcatcctatgacctccttcctggaacccagagattctctgtaaccatttctttcactctcatgtctttcctttttctgtcaccaccacaaagctgtccccggtccccgttgctccttcctccctcaattccttcagatttccaaatcagaaatctggttcagctccatggtgagcgactacacacggtctgcctgtctccgatgctgggcttgtgtgtgcctgtctctgcatgcagccttccggccagcggtattccaccatgctttcaaaggagcaacctggactcgtgtaaaaatatcagggtctctcttccttaggatataaaataaaatctgttcagaagagagaagccagccttctcctaacgagagatccacggccctgaatcatgcagtgagaccacttgcctgccccacagcctgtggttgcttttacgttcttgccgtgacatgcagactgtagccccaagtccccaaggacagttaactttgtgacaaaatgagccttggcctttctgctcatttagtaatgtaacagaatcctggttctcatacccagctgagcagccatccttgctttaaatggttttatgttttctgtctggatctttcagcaaggggttaagtctcaggacgcttctgacacaatagatcatttctaagcaggatttcatctctagacccaggtggtccctcaaaaaactctcaaacttactccaaataaagacagaatgacagaattgtagctactgtaatcgaaagctcctactatgggcagttctaacacgccttacatggtccttggctaaccctccaactcacagccttctcctcgttctctatgaggctgctgagatcagtgacttgccccaatcccgatggcttccttggcctgacgccttcatctgcaactctttgcagcttgggaggtggagagctgtgttgaccacattctccactacagtcaggcgcatgagttttaaccttgtcacactttacctttctctcctgtcattccccaccaagcccagaaatgcaaaatctcaaggtattatatgtgtagctctacacatgtcagtcccgtgtggtcacgtgtgaagtagatgtcatgtgacttccaaagattgtgtttgcacagtagaagcagactcttgggtgtggatgacagtgtgttctcaaagctctcttgtgtctctgcagctgacgaagggagtgatgatggaatcgagaggacgggataatctctgggactagacacagggcggtgggtctaggtcctatcccaaaggatatgacagactcttaagacctcctatggaaggcctcaccctcccttgaactcactcactctgtagcccaggctggccctgaactcactcactctgtagcccaggatggccctggagatggtgtccctgagtcagcctccctatgcacacaggcctggcttctttcttgttgccttccttaccagtatttacggtatgacttacattttttttttttttttcagggcaacagtgccatttgcttttaaaatgttagggtggctgtaagaccagttaattgcacagtgaaatcacacaggatcagaggtgaactaaaagcctatggatatcagttgggctccagtctgagctgcacattttgtcacagcagccagatcacggccacaaactccataggagcccattgttaaatagaacacagcggcaagccgcgggggtctacagagtccccaggagcaaggactcactctgtttctgctttggaagaagagcctctgttatttaccatgatgagtgcgaagcatggatgggttctaacagaattttatacattaaaacggcaaagcgagagcatttctcagtaactgtaaatgttgaatcaccaggctagaagcatacactgttttcttctgctgctggtctgttagataacatctagtcatctttctaataagctcagctcgaatataaacagccggatcccatggtctctggggtgagttttaacattgcagaccacacaggtattcatgagctgtgtgtaacttgacctcttcagaacaaggacagaacctactgcagaagttgagaaatcaccaggtttccctcagctggccctgggattgtgcttgactcccttttgcttggtgtctgggagagacctgcatgatagttttttctcactgatgtgacaaggtgcccagcaaaatcaaattaaggaaagatgggctcattttggctcacagttctgtggggttattccatcatcctgggagagaggcaacttcagttagagacagtggtggaaggctgggaagccagctggccacgtggcttccccccctcaggaagcagagtgagcaaggacaggatctggtctccaaggcctcaaggcccaccccctggtagctcacctcctgtggtgaggccacacagcctcctcagacagcacctctggatggggacaaatggtgtgaacccgtggagacatttcacatctgtcactagtgaaacacacaagaaagtgttttcctgttgggtgaaaatgtgtcagccccagagaaatggaggaattctgagagtaggcttcaggcattcccttggttggagggaaaataagggcagagagagaggtttctcttctctaaccagggcgactgtttgtgctcactcagaggacacctcttgctttatgccagacagtgtgctaacgtgacagccatgaagtgagtgtgcattccatgtgtgtttcacacttcggttgcaggagcccttgttcgccgcccgggtggtttatgacctcctcttcttcttcattgtcatcatcatcgttcttaacctgatcttcggtgtgatcattgacacctttgctgacctcagaagtgagaagcagaagaaggaagaaattctcaagacaacctgcttcatctgcggtaggtgcccctccaccctgtgttatgacgagagatgggtaaatcacccctaagataacggattgacaaactgcttagcaggaaggaggggtgagaatcatttccagttttcaggttttaggggaaattattttagtgtgaaggctggacaacattcaggttacgtaatgccacgtgagactgacactctctgcttccataaatagatgcaagaatcacccccaaactcccctgccattatttctgcaatttgtacagtcctctgactgtagagtgtgctgccagatgccaggaggttccaccaactggcagatgggtttttaatcacaatagcatattgagtgtattacagagtgactttttattttgctagattacgaatcacaagtttccactcattggcatcactatcttagattcaaaaccaggcattgtcccagtgttaaagctatacacatatacataatatgtatatcacagaccatacaactgctatagaacatgccccatacacatacatcatacacctgccataccccatgcaccggcagcacatgcaacataccacaggctgcgcgtgcgcgcacacacacacacacactcactcacacacacacacacacacacacattctccacatgtgcacacacacacacacacacacacacactcactcacacacacacacacacacacacattctccacatgtgcacacacacacacacacacacacacacacacacacacacacactctcacacacacacactctgcacatgtgtgcacacacacacccttttcttctgcatcattgcttacactgaaccaactttcccttcactgttatgataaatctttctgccaaaagctgcctgagttctatcgccatgtgggcagtctctgccagccacctaagttctgcctgccgtgtgaatggacaaaataatacacagacttgtattaggtacaaatgcttcttggccgatgactaggattctcaactgttagctcagtcttaattatcataaatctatatattttataagccttatcttatcggacgccttccattggtgtccctccttgccggtggatcacattgtgccgctggaggaagagcggaggggaaaagggacctttctgtttctccttgctcaaatatgagtctccttgctatgtcacttcctgcctggatcaccacttcttactacacttcccagaatcctcttcgactcctagtcccatgtaagttgctgcctcactgaccaaacagtattttatttatcatccggcaaggcaaacacatacacagaagcacttcccccatcacttcacagtcatcttctctcaaaccctcccccttctctatccatcagccctctctggcttcacttgccaccgtggtctctactctgaaccccagtgccacacttacccctctgctgtcctttggtcttcaccacagtgtcagaccatctgacttaaactgggcttctgtgcagcctgttctgtgcctgccgaggcttttcgcacttgtctcattctccttggtggctcctccaagctgtttcatcattcctccagctggaggtgtgcctggaaagaatgcgtgataatacacaagctctggggaaaatgtccatcagctgtgacctgcctgagcattcatgatgtgtgcacagacagacagacagacagacagacacacacacacacacacacacacacacacacacacacacacacacacacagatctcttatgtatcaagggaagtaacagagacctttctgggttactgaaggtgctaagaggacagacacctctgcagtcagggcggggagcagtaacagccaacatgtttccctggacacatggcacagaggtggtgatcagggacaaagggcatcagttagttgctgaagtgggtggagcaaaacagccaggaccagaggtggcacagaaacagtatgggcacagcctggggctcgctttgagtgtcgctgtaaccagacactgcagcttactggatgagaggtctattcgggttctggtttgaaggtttggaccaccatgacagggcagggacggcagtgagagcacctctcagctctggctgtagggatgtgaggctgcttgttcacatgctagctggtcaggaaatggagatgagctacacacctcaaggcctgctgtactcgtgcctggtcctccagataggcccacttccccaagttctcagacccctaaccagctgggttctgagcactaaagcatgtgccttagtgctgtaggactttcctacagacaccatagcagagggacaaggtgttgtcggtgtgagcctcagagtcttactgtaggtggaaaagctctgagtctagcttttgtttgagagcattgcagtagctctggggagtccttcatcaggggattgacctgaaggcagagtaactggttagtaccacagcccagatgacaagtaaggaagatcagtgatagcctgtggtgcagtgttaggggtgcaaggccgagtcaagaaagttaggtgatagaatcttaaaatctttttatttatttatttatttatttatttatttatttacttatttattatgcatacagtattctgtctgcatgtatccctgcaggccagaagagggcatcagatctcatgacggatggttgtgagccaccatgtggttgctgggaattgaactcaagacctctggaagagcagtcagtgctcttaacctctgagccatctctccagcccagaatcttaaaatctttttaaaatgtggatttgtttttatttatgcacattcctgattagcttgtatatatgtatgtgcaccagaggccagagttgtgggcaactgtgagccactatggaggtgctgggaaccagacccaggtcctctgtaagaccagcaagtgctcttaatcatggagccttctctccagctccagaactttgaagtgctgatgtttgggaatgagatgagaaatgactgggtgcatgggtgatacaaagaggctgagtatggggaggtgaggcatgaatacccagaatttacctcagggaagtgcgggacttgagagtctgtagacagtggcagtcagcccccagcccacagattacagcaaaatctggagcatgaaggacaactgcttggtggggcaagtggtgtgtaagcaggaagcagcacccaccaagggtcaggagagagagaacatgggtggaaagttcgcgaggagactggaggacacggcagagacatctgagaatgtgtgcgcacattccacactgctggctccagcatggtgggctgcgctgttgctgctgaggccagcgggcctgtctcagggagggctcagcacgccacttctggcccctggatccacatcagtacatggtgatatcctgagcagccctttggtgttcctcctggagggtgacccagattggagcaattccagaaaaggagtggacgagccaagccgtgcaaagacaagaaccttgtgggagtccctctttgggtggctgtgggcagatccaggtggaggatgatctcctgagcctggtgtcatgatgccaagaatgatgtgtctgtgagctaagatgaaaatgcttcaggggttcctcaggtcctgtgcattatgacagactccccaagtcttcactttataaaggtggcacaattgttgacaaaagcatctagaagagagcttgcttctgccactcaacatgaagagaagcaagagctctgagatctgcattgtttctgtgtcttcatggctcgtgatattgcctctcttcttcttcctccctccccctttctcatattcatctatgcatgtgtacatatatgtaagcacacacacacacacacacacacacacacacacacacacacgtataatttgtgaccaaatgccggagcaaggcaaacaaaaccaataacatgaatggaagaccctgtcctttggtttgtcacttgggaagaccctgtcctttggtttgtcacttaggaagaccctgtcctttggtttgtcatttgggaagatcctgtcctttggctttgtcacttgggaagacacttgtcctttggtttgtcacttgggaagacacttgtcctttggtttgtcacttgggaagaaccttgcccttcagtttgtcacttgggaagacacttgtcctttggtttgtcacttgggaagaccctgtcctttggtttgtcacttgggaagaccctgtcctttggtttgtcacttgggaagaaccttgccctggggtttgtcacttaggaagaaccttgcccttcggtttgtcccttgggaagaaccttgcccttcggtttgtcacttgggatgctttggtggtttacagagcaggctgctcagtgcagagctcagatttgctagaagagagctgaggccaaataacaatctgttgtccatgtctaactggatgaaggaaaatgaggttggggtgatacagccaaagagatgtcctgtgaccactcaggggtatggagaagaaacacgtctggacacctgaaggaatgcttctttcatcctgggagagaactagacccgtgcattttggaggaaagaaagaaaaacaaaatcaaagtcctctaatttctcttctttatgggacacccatcactgttttcacttttcacagtaaattgtttgaatattgccgtccaaaggacagtcctctttgtctgtgtctttggctcccagtgatgtcccattcctttatactagctctctagagaaaagagctctctagaaaagaggttttgatttttgccttgacccccatccccgacactgtctcactatacttttctcccatccatccccgacactgtctcactacacttttctcccatccccgacactgtcgtctcactacacttttctcccatacccatacctcgcttttgccgagtacacatcaccagcaccacactccccaggcttcattttctatttcatgtttactagactgaagctggcacagcctcctggcagccacgtggacccagcccaaacccagtgccctctcttctctgccttcctctgctcagctccagatcctggctggcatatggtagccacagacatgtgtctctgccttcggtgagcagggctggaagctccccctcacatcagtatctctgctgtctccttccaacacttcagcctccctgggccgacagatctgcctccacaggttcttactacaccctgtcacaaattctcgaagccacacatgggccggctcagtgctgctagactaactttcctagtacaaaagccctcagtaacatggtgccatccattgctgtaaactcctaattttcctggcaataagacactttacaatctagacccatctccctcctcctctccctcttctctctcttcttcttcccccttcctcttcccattctttagtgtattttcatccaatttatgtttcaaatccagtccaagtgcattccctgtcgttctcatcctggactctgtattcacagtagtgagagaatgttctggttgaaataccaaacccctgtgagccatagcactcaccccgtctctgagacccaaccccaatactagattcatgaacccttttgcaggctcactcggcaggataagcatgggtgctcctgaatggctgtcatcacgccatgctcagtgacatctgtttgcttcttcttgacggcatgcaccctcttactgtagaaagcatgtgaacctcttagacaggcagacacagccttccacagtcccatggcctgatgatgtagccttggccaaccttctttccctgagcttctctttgctgctctggaatgaggagagtctgcagccaggctttgaggctgtggtagctgtaatcgagatcttgtttataaaattctctactattgtgcagaggtgaagctaactgtgcttcttcaggagaggtagacccatagacgtattaaccgtttttattctcccgtgtttgatgtggggctcattcatcagtgtttgttaatgaatgacagtaaatcaacatgacattgctcgtcaggtacgcaaggaagggaagaaagatcaatactgagttgatctgtacttcatatcaaaacctagatgcagactggggagatagttcagtgaagtgctggccatcaagcatgaatgcctgagctcagacgttcacacccacatgggaagctgggcacggcggtgtgagcctgtggcacgctggccatccagatgtccgcactcacatcgaaaacatgagcctgtgaactttaggaggtggggcaggcttactggtgctcactggctgtccatgtagtactcaagcaaagtgagaagtgcttgagaaaatgctcaacatccccccctggcctcgacatgcatgtgtgcacataagcatgtatgtagcacacgagtacacagacaaaacctgactctgactatagatggctccaaattttgccacaaacttggtattgtctcagtgacatgacacgccaaggcacggatgacatatccagaggctcagggtgatgctatgtcaatcaagtctatattgatttttctggaagcttcatgcttattcaaaagactgaggggctgtttggtaacctaagctcagagtaaatctaaacaaaatttttgtattataatcaatagaatatcgtgaagtagagcaaatttgtgtgcatatctgaaatgaaattgaaactttgaaaaaatgtgggctggggatctatagttgagcatttgcccaccatatgtgaagaaccaagtttgatttccttttaccaaaagaaaataatgtaaactggggacagagagctgtctcagcagtaaagaacacacgctaagcatagcttagctaagtagaagactagactttggttcccagcatccatgtgggtggcttccaaccacctgtagctccagctccagtgctctcatgcctcttgtggcctttgtgagcatctgcacacatgtgtgtatatacaccaacaccacacacacacacacacacacacacacacacacacaaagaggcctggataacaggttagctccatggtaaagagaagtgctgtggtgggtgttaccagaaactcaaggcagagaataaaagtcactcttgatttctcttattctcctagtccaagtagattttatgccctctcgggttttcactctgaaatgtttcttcagtcttctccatcatttattcagttcttccatcaagtttagttgaattcctgtggttgtctgggtaatctgtagggggcattcaaaatctaagcagacaggggatcagccatctggttgtgtctgtgggagccggtggcgccaaaggctgagctgggtcttggagaagaagcacctgcaaggtggaagagaggcagctggagacaagagtctttctgagaacatggagaatttggagggtggaagaaaggtccacgaagaggtcagcacaggagtctgagagtggcttcaagtgccagcccatgggacatcctgattgttatcagaagtggaaaggggggcagagaaacaacttttcagtgagctaagttggataagcccaggagctagccctgtggagttctctagccagctgctagatatggaagtgaacttggtaatgaaggtcagtcttggaggtaatgttccaggaaccaccagcgtggtgatggttatctttggaagtgaatgccgcactccagagagcaagagcctatgagcatgaagtcaacatgacccccaacttatccattctcctccattgtcctggctccttgccctctccatcagtctcccctaccatcccccaaagttctgccccaagaactacttcaagtatagttctgaagctgctgtttccacccacgagtccacagcacaaaggggaaatgccatagatttcagtttgagcaccacagtagacgggtgaccttttctacaccaggccacccacattcgtctctagctttgccacctcgaggcctttgcccatgtggacctttagagtcaggagtggctctgttcaatgctgactgattcttcacctaactacaggggttagcttgaaccgttctggatctgtttcttggtgtggataaacgtcatgtcggatggtagggtttttagacagctttgtggtcgccagcagaaataggtgctcaataaaacccaggtagaatttacgagcatgtacctctcttccgcttgctgaagtcatcttctgagagtctgtaaagctgtctgcctcctcgaagccgtttgtcatcttgtccgctatgctcccttgcccacacaagctgcttcagagcattgcacgttacctggtcccgctaccacgttctagggtgagtgatgatggaatcagtactttaatactctattactttgcagacaggggagaggcttgaatttaattctggggaatcttactttaatactcttctttttaatcaatagctctattgtgatgtccttaaaactcaccaacttaaggcctacagtgcagtgcctttaacgtattcagaactgggcacacaactttatgatccatttcaggacatatttactgccccttcccataacactcatccatcatgttctcagcagcctcccatcaccctgtgccctggccgaccgctgatctgctctctgcatctgtaccttttcctgttttgaagattcagttaagatatctggtctttatcactagcttgatgcttgcaaggctcctgtctgtgctggtcactttccccatggctgacagactatctgactgagcaacatgcagggggaagggttcccttaggctcacagttcaggagatacagtccctcgtggcagtacggtatggcagtgggccagctcctgggagtccatggtggctgtgggaggtgtcgtgctcacatctcagtagactgagaagagaaggtgaatgtcagtgctcacctgcttcccctccccccttcactcattccagttctctagcccataggatggcacctctcacattcgggctgttccttccttcctcagttaactctccctggaggcaaccccacaacacgcacgtgtgtgtgtgtgtgtgtgtgtgtgtgtgtgtgtgtgtgttttatgtgccctatatgagaaccatatatatggtcatcagaggccagaagagggcatcagatccactggacctggaagtacaggccgtcggaagctgccatatggtcctctgcaagagccctgaatgctcttaaccactaagatatctttccagctcccccagttttttttattaattcagattgaaaatcaaaattagccctcatgctgcataatacctcacgtaagtgcttccagcctttctattgagcagagtgttctatcggatgctgagaccgatatcagaagtcttctttctgctcctcacgggtgggcattgggtttttttttcaactttggggttgcaggaactgtgttgcagtgacaatccttgagcagggtgctgtgtgtatgtacattctcccttcatgggcacctgggcatgatctccttagtcatgcggtgactgtgagaattctttagaaatggcttgttttgcaaagctgctgccctgttttacatttcttttagtagcctgagggcccagtatttccagaccctcccagcactgtcatcatctgctttcaactttagtggaagtacattttactactgagtgctcttaactcatccaatctcggtttcattgaatgtcaactgtgtgtcagacacagttgtaaagtcttagggccatggtgaagagcagaggcacaggtatctgtagtcgggaaagcatgtgagtaataaatattaggccaggcttggtcgaacacgcctataagcccggcaatcaggaaactgatgcattaagatcctattactgaagccagccttttttttttttacatagcaagttccaatccagccagggctaaataatgagacactgtctcaaaaacagaataagacaaggaaggagtgagtatagatgtgtgtgcacggattcgtgggggagcacatttcttcctccatgctggcccgcagcaggctctccctcgaaggcgtggctactctgttacctatgagtcgaattgggatccagtgtaatttagcaatttccacactgctattgtcagtgtgatagaaagtggtgaactaggaaaggagaggcatagtgacagatggcccagagtgccaggaaatgacaagggactgtgtgtgtgcaggacactgtgtcaccaatggggagggactgtgtgtgtgtaggacactgtgtcaccaatggggagggactgtgtgtgtgcaggacactgtgtcaccaatggggagggactgtgtgtgtgtaggacactgtgtcaccaatggggagggactgtgtgtgtgtaggacactgtgtcaccaatggggagggactgtgtgtgtgtaggacactgtgtcaccaatggggagggactgtgtgtgtgggacactgtcaccaatgcggagggactgtgtgtgctggacaccgtgtcaccaatggggagggactgtgtgtgtgcaggacactgtgtcaccaatggggagggactgtgtgtgggggggacactgtgtcaccctaagtcacctgccaatcagagttcaccagaaacatccatgaatgagttagccaaggacacagcagcgaatgagttctgtggccagaggaaatgcctagcctcggcccctgatggaggaatctgtctgtggaatagcagaggccagcatggctgcttatacaccagcagggggaggtgaggaggtgaggtcagagcagcagtggagccaggccacgtgggagttagcacctaaacgttacatgagacacagacagactaaataactataccttgtgtttagtttcctcttctctgtaattggacacctggcatactcctatgtaaggaggaggggtttgcttgggcttctactccagaaaagacaatagacctcatggcaggcaggacattttcagggacctgtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggacctgtcctgcctgtgtgggtgggtggggggggctgctgactcacaccttagtagataaggaagcagaacacagaaggctggcacttagctgccttcttccatcctgatgcagtccttttagtctggcctgtgggatggtttctcctacattcaaaggaggttttctcctatcagttggctgtctctggaaacagcctcatggacacaacccaacctattccctaggcatcacttactccaatcaaaaattctggagctggagagagaattcagtggccaaggtttcaagcctgagacctgagttcagaactcagcatccacatgaaacgcctggcaccgctacaggcagggttgttaacccctgcctcatggagacggagacatgagcaactctgagttgctagctgtcagtgtgtctccagcttcagtatgagaacctgcctcaagtgagtaggtcagagagagccagagtaggagtcccataccctgcccgcccccacacactatctccaccatctatatggaattcagctgtcactggacgtctaaatcttaacatctgtgttttatctaatactgtgtaagccctctctaccggctgttgtgaggggctgctgtgagggccacagccaagcagagcctccacattgtgaggttttccaggagtgactccagctcccctgctgggagtagagggcacaggtggacacaggcagcctgggccgataatgagatgatccacacacacaccggaaggcaatagctcagagcacagcctcagcagaggaggcccttcaacacagacagacgcatgtggatatgtgctgaagaagaaatagaggaatttcaacgtggatggggtatggcgtgtgagaagcagagaaaagccaaggatgactcctgggataatgacttggacaacaacactggagtagccactatataaccagagggaggctgtggtgggaacacattggagctcatgtccgacacgatgaactgataatgggtcaagtgaaatgaggtaccatcaccagatggctgtattttatacagcattttcataaaaaaaaatccaataacaacttcaaaagtcaacccatcactggggacagatattcttaaatgtatttgttttgtaacatgcttaaagaaaggtttcttcatgacctttgaaatgtgcacagggaaggagtagtcaggactggaactcagtttcctggcgtctcctctactatctgaacagcaaagatgaactcaaccctgacatcccgtctcccacaccagtaagagttgttttcccatggatgtttctcttcctctccattcactgtcttcataagctcctcgcttgaagagaaaagcctgaccactcaaatcctcccataagaaggccagtaagcatcagctcctgtctccaggtcccagccctgcttgcgttcctgcctcgacttccttcatggatagtctatgaattgggagtgtgagccaaacaaactctttccttccagtttgctcctcgtcgtggtgcctcatggaagcaatagggttactaaacaggacataaattgtgccaggatggtggggtgttgctgtgacagacctggccttgtgttttggggaggatcgtggaaggagtttggaattttaggctagaaaagccattgagtgttgagagctcagtgggctgttctgtaggagcttggaagacaagaatgttgaagtcattgtggatggtggaaggctggcttgtgaagtttcagggggaggtttaaaggctatcagagccatttgttattcggacttaagatgtggttctagtcagctggggctgaagaattagttgcgattaacaagagactagcgccattgacgtgaaacctttgctgggacaactgatgctggttaggtggagctgagacaataagcggcatcattgaggaagtgaaatcttgaggaagtgtttcagagagcacacagaaggttgtacttggtaatggaagtgtcacccaggtgttactggttctgaaggcatgaagggggcgtggaggagcagctgaggcttggctgtgggaaagcccagaagtgttgcaggtgaccctgctcagacacccgttgggggagggggtgagaagacgcagcaccaaggactcaggcactgggagtcagtgagtggcagactcatttattcaggaaggtaggcctgcctttatacccactcccaaggttctgtttgctcagcggctgactctgctgcgttgtccttttctcattggtgtctctggtcaggtgtctcttcgtcagtagtctctgggcattgaggcaggcttggcagtttggttcagggaggaagtgcctgccgcgcatgctcgtgtgggctggcctgggcacctgaggcagggtgactggggcttgggtaggccggccgcagtttctcctacaccgaagaagccattggtgaaggtgcagcctcagtagcagtggcagccctaggattaaagcggtcatgaagagaagccgaggcttgtcaccatgaagagaccccaggaaagggtattggtgggagtgcagcccaggtgcagcgggaagtcccaggcgtttggagatgccagtgctgtgaggtgaccatcaaggacagcagccgcagtggagtggagcctggctcagcttagagtatgagctgtgtgtgcagctcagtgtggtgctggaggagcgacccaagccccttgaaggagcccagaagataataaagaatccagacattgaacgttgagttgtttacgctgttggagcttggttttgctttgatctgattttaactgtgctctgactcttccctcttgaagtaagaatttattatttaacttattttcttattttataggacccacagtttagagacttttgattttaaaagagacttggggtcttttaaagaggaggaactgttttttgagtttgtaaggctgtgggacttttaagtttgtaaaatgttttacaatgtgatgtttatattaaatgtgtgatcttggggatgaacaagaaaggaaaggttgtgactttacagtgatgtttttgtgttgacaagggattgattgggctgtaaagttttatttcaatttgacacaagctagagtcatcagaggggagggaacctcaattaaggaaatgcctccgtaagatggggctgtaggcaagtctgtaaggcattttcttaattagtgactgaagtagggaggcccagcccattgtgggtggtgccatccctgggccgatagtcctggggtcttcaagaaagcaggctgagcaagccataagaagcaagccagtaagcagcaccctccatggcctctgtatcaatgagctcctgcctccaggttcctgccctgactccttcagtgatgactggtgtggaagtgtgagccaaatgaacccttctccccagcttacttttggccatggtgcttcatcacagtagtagtacccctgactaggacacctgagaattgaagtggccacccaagccccagcttccctgagtgtcatggaccaggggccctgaggagagtccttacccctgcacagtgtgctcagggctgtctctggttgcaagtgactgaaggcacgactcagatgctttcctttaacccaaggccttgatggaaaggaatctctttttttattcctgccacaattagccagcattccttttatttgttgttttctttctgaaatccttattgtgcctgtgagtgtgtatgagtgtgtgagtgtgcgcgagcatcagcctgtgtgagcgccacagcacatacatgtgggggtcagaggacaactttggagtcacttcttgccttccaccttgttttgaggcagggtctctcttgcgtttctgatgcctgtgagcttccaggcatatctccggtctctgcttcccaccgtgcagtaggaatgttagggttacaggtgtgctctgctgaacaggaccttctgtgaactccagtaatcaaatgcagattacctggcttctgtggcaaatgctttccttttcttgaacaattatcattgtctctttccgcttatgcttttggcctggttgagtttgatagttttatatggtctacatttaagatcacctgcaattctgacctctgtaatagaactgcacactcccaaggatcacggggaggaaaatacatgttagttgggaatgagtctataaaccacagcctcttttatctagagcttttctgtattgttgtttctaattgtaacagtattttaaagaggcacactcttccagaaagcaggtttgttgttgattttttaataatggtcatttttattatgtgaagaagtcatgattaacagaaaaattgcatacagtgtttcctgtgttttgcaggcctggagagggacaaatttgacaacaagacagtctccttcgaagaacacattaaatcagagcacaacatgtggcattacttgtacttcatcgtcctggtgaaggtgaaggacccgacagaatacacagggcctgagagctacgtggctcagatgatcacggtgagtaaggctgcctcagccagtcctgattctctaactgtgaccgtatcagaggccttcagtgtccatctctcccctgccttcctcttaggtgagagatgttctagctctggcttttttgtgagactttacataggcttgtcagttactggataattttgacattgctgacatcatccttgttatccatcaaatctgtgtctccagtgaacagataacatgttttcagggattatctgtgtagtgaagagtttcctactaaagtctctaacctctggccccaaacctccagtcatcactggacctctcagttctcaaatctggaagtttcatattgtcacatgcaaacaaaagtcatgcttcaaaagagtccttgaatttccaaaatcaataattgaaaacatcttgtgtggggttttggatgttctaggggagcctggtgggagaatgccactttctggttttagagaacagctgacccttctgttcagtcctaagaatggtacttgtgtgggggagtgaggtgaggagatcaaggtgaggagagggaactaagaagaggggttaaggagagtcagtaaggtaaggaaagtggctttgacctgaccctgaaggagcaggtcacctatttagataaacaaagacacagtactggccacagcctgcttacccatccatccatccatccattcatccatcatccatccatccatccagccttcatccacccatccatccatctgggcattgtcttattaacagtgtgggttgacacagtgttgacgtgcttgtgtgtctccagaacactttgtataaagagcttccgtaccttggcatctttcaggcattctcattcctgatttctgattatggctgctttctctgcatccttcctttgagatggacagaatctagtagtttgtctgtccctcacatttatctctctctcctcttttctaaatgtgggggaaaggtaatgagtcccctgagggactctgtcatggctgtggccacacattctggacagtgtttgtgggaaacatttcccagctgctcatcaggagaagggcatctgagatgcagaacttacagaatgtgacctcacggctgtaaatggaataactgtgtttatctggctcccctcaagtcttttgtataaaatatttctgggaatacagaatacgcccccttctgtagaactcaattgtgggggaacaaccagctggaagtgggtataccaggtgtgcccagtcatgtgatgagaatccaaagaggctgaaagtcagagtggtgctcggtgtggaaaggtatgtcagggtgtctgtgtggcctggggggtaatggacaaggcaggacttgtgcagtgaggtttgtctgctggatcagagtgagttcctgtgagaaacagccaaacacaggctggcagtaagtcactcagaccttcagaggtgttagttagctttcatggtcagtgtgacaaacacacacctgtcaggcctcaaaggaagaaaggtgtgtgtgtgtgtgtgtgtgtgtgtgtgtgtgtgtgtgtgttagcacgcatactcttgaggtggggagttgtagttgtgcctgcatacacctacatatgtggaagccagaaattgacatcatgtatatgtctctatcgttatcactttctaccttatatttgttctgagatagtcgctcttcaaatctcgatgtgatagtttgaatgagagtgactcccacaggcttgtatattttcatacttgatctgcacttggtggaaatgtctgtgaaggattgggaggtatagccttgtggaggaggtgtctggctgggggtggcttagaggtttcaaaagcctttgacattcccggttagctctccctgccttgtgcttgtggatcaatatgtaagctcttagctatggctccagctccatgcctgcctgcttccatgctctctaccacaaaggccatggcctctaaccctctggaaccataagccaaataaactctttcttctataagttacctttgtcatggtgccttattacagcaaacataattatgacactggagtttaccatttcagctaaactggctgctcagtgagctccaaggatccatttatctccaccacacccctacccagcactggagttgcaggcacacatgctaccatgccaaggatccaaacctagtccctgctcttgcaaacagcaagcacttttcccactgagctgttacctggcactgaaagagtcattttgctcatggttccacaggttcagcgcacaaccacctagctctgcattcagggcccagtataaggcaaggtatcacaacagcgggagactcttcacctaatggccagcaggaagcagaaatgcccacaacttggtggataggaagcagagtggagccggaacgggaaggggcaagggcaagatggaggctctagggacatgcccttccccagtgaggcctcacctcccagtagctcagtgtgatagcaagttcaccagtggatcgatcactcactgggttgcagccatggtggtctgattgtctccagccaggtcctcatcttcacacatgtcattcccacatggtgccctaatgacctctcaggtgctgacccatccaatagaatggacaattgaggccggtcagatactcagggcctccttagtggcccagtttcactgctcgtaggagactcacttggaggaatttctgagagatggcagaaaaagctcagttgaaattctaagtagtacatgtcagcgtctgagcatgatttcactagcaacagaaatccactgaaggtcactgcccagagagcagtgtggcctgggatggtgtcaggaggtggggtgcaagcttctgggaaaaggaaaagatagcaccactgatggcatttaacagtgagtgagacagaggtgacggtggggaaggagggctggacaaacctggcacaacaacctaggctaggcatgcagacgagaaagatggtgtcattgggataggacctctgtcaggaggagaagccgtttggggaagagaccagggtctgaagtgagattggaaattgagaatagtgaattttggggacagtgaaatgggaggaacctcatctctgctgcagggtcctggggattgtaggtgagtcctggacccatctcttaccctcacctaatgtggagagactgctgtgttctccctgacagacaggagtgtgtatgttcagggtcatggccgcactgaaagcaggggattggtgaattcactagacccaagataaatgataaatgggtgttttattggggaacaacttacacagataagagtaaagaacagtgggtgttcctgttccttccgatgccagccagggagcctgacctgctgcactcctctaccttctggtcatgtccacacctgaagccacacccaaaggggtgtggtgattaacacaaattcactgacagggctagatgttactacacagcactgcctggtacagtgcctgcattgttgctcttaatggtcttgtcgctgtgtaatccaggttgtcctggaactcccaattatccagccttcatcttcctaatgcgggtgtataggtgcagccaccattcctggcaagtgtagggacttacatagttctcactgggacagcatctgagccagtaggctagcaaggtgagcagaggaaggcaatgcaaagagagggggagaggccaagtcacagctgggaacctgcttaggaaactgaaggcagacagacacaccacagataaataggacaagaaggcaggaggctccaggggctgaaaatgtcaagttaacagccacaagaagcgtcaggtgtgagctctgggctccatgagatggaaatctcttcctgcaaagaaaactacagtgaagatatgaaaccatcttcagacctgacatccgagcagcattttatcaggcaatccctttgagtgtctaagtgtcacagttcttattgaggtcctgccctgcccacctatgtcagagcccttttccagaaaagcccaggagagataagagtctacaagtttaggctagcaggaaaagtctcgttcttgtcctagctatatgtctctagaaccaagtttctttcctgaattattttaatcagcagaaaagggagaggcatattagctcaagtttgatgcaaataagacagttcaggtggaagattgctgattccagcaaagcaaaagcctgtatgttacacacccaattcggaaactttctcactccaggctttgtgggtgtatggctgtgtggtcctgattctccaacagagattttagcacatacaattccacattctggagtttagaatcagacagcacgtttgtgcttctgtgtccaaccagtgacagaaatctttgtaaaatattagtgtccctaactctggaaacaggcttcttactaaacagtgcatggatatttgaatcagcacagagcagaccagtctgggagatggttagagagggtgtttgtatctccaagctaaatgtgcacgttttctcctggcgagcaaacttttgcctgtggtaagaggattggcgtcactgggaactgagaatgagaatgagaagggagcacccaggaaagtcggagggggggggggggggggggggagaagcaggtgaacacggaggagctcctggctttttcctggcaaaacttcgagcaccacaaagcctgtttgcttttcctgtcatcccaaagatgacatctaaggagcagcaaaccgaacagagatcattggagaaagtgtacaagatttttagccaacaacttggagacattctcaggtacccatgttatctgcggagatgtattgggggctttggtgatatttgctacttaatttgacaaaaggctcacaccaaaccagagctgcacataagaggaggtccctgtgtattcaggggatggctgatcctggttgtccctgggatcccttagctacctgtccatgaccatgacttttaggggccacccctgacagattattacacctctacatacctctgttcattcaacctttaacaactacttcctgatgtctgcagtattgacaaagacagtttaattcatattttttggtagcacaatagtctctcttcacacacacacactaatattattgaaggccttagtagggtattgctggctcttcgctctgcacacagcctgggcaactgatatctgaaataggtcagaagcaattcagtagacacgggttatccccaacatgctcgggactatgctaaaagtttgatgtttacagctaaataagaagttatccaccaggtgttggtgtcgcacgcctttaatcccatctctcgggaggcagagacaggcggatctctgtgagttcgaggccagcctggtctccagagtgagtgccaggataggctccaaagctacacagagaaaccctgtctcaaaacaaacaaacaaacaaacaaacaaaagttatcgcttccttgaggaagcttaaaacattcactgaatgaataagtaaaacaaaaagtgaattaatgagtgattaatttccttctagctcttctagccttctggcaactggacataatttgtagaaccatgcaccaaatcaagctgctccaagaggttgacatttgaatttctcatcaagaaagcaggcttttcctttctataaaaccaaaaggtgacagggtgctgtcaccacaccatcagaccagcgctttcatttactgtggcctgcccctggcacgctgcagcccagctcccccatcccacacaggaggaacaaggaacatggaagagaataggtgaggctttcagtttaactcagcctcaagaatgggtcctgtctggaagctatctgctatgaccagagaaagagagtttttttagtttcccactgctgtgataaaatgcttgaagagcagctcgagagagggagggttcgtttgcgtccatggttcagggaccagcaataggcatgtgggggcaggaatcgggaggaagtgaaggcaaacacgtgtgctggcaccccctttctctctgcattcagtctggaacctcctgccctgaggtggtgactctcacactcagggtgggtcttcctttcccagataaatccctctggaaatgccctcataggcacacccagtgtgtgtcttctgggcaattctaagtccagtcatgctgaacatgaaaatgtgtgatcacgggtggcttcatctttctcatgagacaaaaagaaagctaatcactcacctgctgtagccacacaaggagccaaaaagaactaatgactttccaacattgatttctgagtctgcaacttgaaataggtcttgtttagctaaaccatatttgtgagcagtaaccggcaagggcaggggatgtttggattcatggaagacttcaaattgtctgagatttacttgtcgattgctttctccagtgccatttccagttaggtttttgcattattgttatgtgttgtaattatgaaattatatgttctgattccattctttttaatctaccctgatttcataattggatctaatgaagccaattaggtaactgcttcatttttaactaaaacctattttaaagatttgggggcttaataagacactttttaaaaaatgtttccgtggctaggcaagccaaaggggtctttgcgattcaaaacacatttatgcgggcagccaccaccttggctgcccactggtgtcttcagcttcggaaggctctgctcaagttccggcctggggctacccctccagtgcaggaactgcccagtgcattgctcttgtttttgacttagcatccatatggaaggcccagaaattgctaccttgtaatgtgggcacgttcacccggtgtgaacccctctggctattgtgaaacagaagttgagagtatatagccgtgtggctacctcactccgtggggacccatcacctcagactctgtcccagcgctagacatgagggcaaagggatttgagctttattgtgtcaaaatgctttgggtgggctgcaggggcgggggtggggcagggagggagcaggggtgaggcagtaaggtaaggagtccgagcagctccagagtactgattgaatccaggaaagaagcccatggaagtggggtgggggcacctgctttacccctctgctcgtgaatcgccccgttggtaaagtacgcatagtgggtcagtcagaaggcagaacagaagccaagtgaactgaattaagaccccagagaccccctactgtccctggctgtcctagggtaggcattcatggtggggacacctcagaggacgagggagagatttgtagatcttgagacagtaggtaacttgacgacaggatggtggtctgtgccgtttcagcattcccatagccctgtctcagaagttaaacgtggtctgcacatgagcaaagccccttgaggaactgcagtgtagttcagtaaaacaacacacacttaagctatcacagacacagatgaccttgactctctgtcaaggctgcacaacaaccaagaggatcctgataacatcaccccattatacatttaaggaggccaaagcttagagatgacctgcccagtgtagcacagggaacccaaaggggtggagtgctgtgcccacaatgcaccacacacaggaacagcccctcaagtctcagtcaggacccctgtgtaacacagaagccctgcttcctctgagagcaagccagcccagctgtcctcggcccacccagcagcacccgtacagaggagcaattttaagaattcagtccacagggcagggagtagacctggctgggagacaggaagtcagatgacagccttgcggtggcagggaagcctgagaggaattctaatgggaagagagagctggctggtacaaggacaggaacatcatgactgcagttgtgaaagcttaggctgtctctgttaacccgacaagggttttctgggggacactctgcaccagaccacgataaacacaaggaaaagaaaaaaacatttgcaccctcccaggatctgttctacagattcacagttccacatggaggaggacggacttgccaacagccagagagactgaagagacgtaatcattcccctaggacgcagttcctcctggacctcccactcaggttggccccagccttaccaggtccatttcacctacctgctttcatagccagctacacttcagctagcttgacattgtgggtttgtgttttgtttagaaaacactctgcctttctttgcctggccacagccttggcatttgtgtgcagtctgttggccttcgtgtgccccgactctttcatgtcgctggccgtgtttcttgtcaccttccatcccaatcccattcccactgctccctctctttgtccttaccccccctcctctaccttccctctccttttctctcctctctctctctctctctctctctctctctctctctctctctctctctctgtcatctcttcccccctctgttttttgagaccaggacttgctctccagcacaggctgtccccaagcttacagtcctcctgccccagccccttgcatgtcagggttataagtgtaagcctccaaaatgggccccatccttttagcatttctttacagccgtgacttgttgcgcacagtggcttctttatcctctactgttacaacacacccccactagcacatttacacagatggttttgtgctccagtgtcttcctagtccagagttagtgcttggtgcacagtgggcacttgcatagatttgctgaacaaaacagacatgacagagagcggctgcagtagagagggcaaagcagtaacttctgcaccagagacgcttcacagaagtgactgtgagtcaagttgagccttttaaaaatgaggattttgacagaagagacagagaggaatgttgtccaggcaggatatgtattgggggggaaagagggagggagggaaggggagggatggtgggactgaaagggggagggtggggaggtggggagggctcaggagaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggtggaagggggggggggggcacggtgtgtctgtgacaagagtgacggtcaagaggtcaggtgccaaccaggacacagagtgcaaagggactgggagcttggagtctttattctatccggaaagctaagagagcccattcagagacagtgaacccaaggtggggttgagaggggcacatgagaaggcacagtctggggcacgaggtggtaaaggcgctgccgccacacccaaagacctgagttcaagtccccagacccactctgtggaagaagagaactgaactttgcagtttgtcctctgacctaaacacacacacacacacacacacacacacacacacacagacaacacacacacacacacacacacacacacaccacacagagacacacacagacaccacacacacacacatcacacacacacacatcacacataccacacacatacgccacacaccacaccacacaacaccacacacccaacatatacaccacacacacacacacatacaccatacacaccacacacacatcacacataccacacataccacaccacacacacacacaccacacacatacaccacacacacacaccacacaataccacacataacactacacacacacacaccccacacacaataccacacataacactacacacacacacaccacacacacacaccacacacaccaccacacacacacacaataccacaccacacacacagagacacagacacatatacatatacatacaccacacacacacacaaaccacacacacacacacacacacacacacacacgagagtgggggagccaggggggcggggaggggagagaataagtgcaatttaaaagaaagcataatcataatccacaagaaatgacaagacatcttggaaataaaagaaaaatctagaatgattcactctctggcagcaagactaagagcacacattgaggagacggcacggtaacggagagttaaaggggcctcgctgatcacggagcatcttttagtcttctggtctgtgtggttgtgggtattgaacaagagagggggacaagagttgcagggctggtggcaaagagaagtgttcgccccagactggcttcctgtctgtgggcacagggcctaagaagaaactgaggacgtgagtctggggtccatttgggaactcagaaatgaagtggtgtggtttgcatgggaaatgtcactcttaggctcatggatttgacacttggttctacagctggcagagctgtttgggaagggttgtacagtcccctagaggccttgagggaagaagtgggctcctggggccttgagcttcttagcccaggactacttcttgtctgcagtctgcttcctgttcttcttagatgtaaagagtccctgccacgtggtactgctgccatgcccctgtctccacgttgaaactgtgagctagagtaaatcctccttgccagacattggaccagagctattgggagaatataatgtgtgtaccatccacaaagataacattttaccgccgtctgctatgtagtagatacaacaaaggttccttagccagaagagatggctgagcagttaagaacacttgctgctcttgcagaggacacaggttctgttgccagcaccccctgggggttcacagcaggccataactgcagtttcatgggatccagtgccctcttctggcctctgtggacatcagggacacgttcagttaacatatatacatgcaggcaagcactgatacacatcaaataaaaacaaataataaataaaccaaaaacattcattaactgatgataaagttgtatgtcactcaagtggtgtacttggagtcacaggttttgacaaggctcctttggagactgtgtggagtgagtgaagaaggggacgatagctcttcagagggacgagatgatgacagcaagctgaacctgattatgctgtatctgctccactcaacaaaatgcagagctagagaagaaaaaactttctctaaaaagaggtgactttcaccagccagtgaacctagacgcggtctgactggtcagtagactgtgacccaagaccgtaaggtttgcagaatatgaaactgcaacccagatgttttattgagcatgcagaccctcagtcacttatttccagcttaaagagggatgttcacatctctcgttttcatcaccccagcgaaagctttctccctgctgtgccaaagaaaatcctcgtttcccagttctggtcattactgtaaggtcttgttgaattctcagtcggctttctggaataataatatccacattgttaggactgatacgttttactcagaaatgctggctttcttccagagagtagccgatgccgtcaagatgtgagttgtgggaatgaaaacggtgtacggtaaagccacaagacccttgctaatggcttgtaataggccaggccagcccgagccccattacaagcaattagttaagacagcagttactctgcacacactgcttggcatggggtaaggttatcgggcaagctcatttccttggggtttcggtactaattgcatcttttaaaaatcttgggaaaatagatgctgaaatttctagaagtgattcagcatttgtatgtgagagaccagccatttaatatcacaaccagtgggctccgatactttgtgagattgagagatgaaggtgttgtgaaataatagtgtctgagataggcaaccccagctttctgggtctgtttcctcacctctgaaccatgagtcttgtgcttgctgagatcctgtgtggatttacacgcatccccatgccaaatgaggtgagtggcttgtagatcttgaaaaagggattcaccattccactcctactgaaaaagctggtttaattcaaataacgtggctacacggaaacactcctttgcatatgcaaagtgttctcgaaccatttaatgcccacacactctgctccgaggagcgtactatacatgtgagtgagctgtgctcatctcttccctgcgtttattagacacggagcccgtgtcctcaatggtaacagcttttgtagtaggtcagaattgacaagaaagggagagttcatgtttggagcagaagggagaccccaaacaccagtttcctcatgatttaatggtgagtgtggccaccagggaaaagtctggccagagggacttctgtatgttactgtctgatccaaactcaaattcttacagcacatgagcctttgataaacctgaacgtcaggaactctgtaaatttgtattgctaggaactctggatctacctgagtttccaaggtctcaggacagtttttagcatggttacataaaaccatctggagtgcccagggagcatgcagggacaggtgtacccgaaagggagcagaagccttgatgctgaggccatgcaagaaggaattctgtctggctgacatctccaccttgagggagcttccttgtttttctctctgtgatggggacactgtggggtgtttagtcagttcttcagagaataccttcgtcagatcttccaatatttgaaaaagttccagcaactcattattctacacacacttaaatggaacttcaggaatgaagaagatgggagagagtatccaaattatttcacttcctcttggtttgttttcacaaaatgcagggtattgactgtgtcaaaagacccttgggagggctggagtaatagcttatttagtaaagtgccctgagttcaatccccagaatcgacagacacaacatcaccacaatccagacaggatattgtctgatagtaatcccagaactggagagttgaaggacaggaagatctctagagcttgctattcagccagccttgctacatcactgaactccgtgcggtgagagacccctgtgtcaaaagacaagatggatagaagtcattcaggtttaggtcaacaatgcacactgagcctctctcttctcttcttcgtccagtggagtatttacccgagaagggagagaattctgtcctataccataggcaagggcagtgtggtttaaaacagggttataaacatggctgacaggcgagtgtggtttctctggtgatctgctcaaattgtagtgtgttaatcagctttcagttaccgtgggggctaaagtaccctgaaataaattattaaaggagagatggtttgcttgggcttctgtttcagaactatgagcctttagtatcttggtccctatcacattgtacctgagtggaaggcagatgtcacgggggagtatatataacaaagtcactcacaccatggcagctgggaaggaaaagcgaaaggacaggttctctgtatccccttcaaggatgtgcctcagtttacctcctacaaccaggtcccgcgtcgccacctcacagttccaccaccagctagaccccaagcctttctgagcattccagacccaaacttgaacccacagggcagcaggctctcctagaataaacatgtgactctttgttcctctttctccacactgggtcttggtttgtttccatttccaggttttcttctcttcatataacttctttgttcctttgattttcctatctacatttcacgaggtttcttttctctgatttcacgtttcaagcaaacctgcttcatgaaatagaatcccttcctatcttcatctgtgtctcattctcagatgtaataaaagctgagatcaaatcatctttaataaagaaaatacagagtttggagagcgcaggtgaactgaggagaaagaaatccatcaggctacaacaatcacagagcgcaaagccccgctctcacacagtgccatgtcgagcaagttagtagaggtgattaagatgtcatagtaaagttagagctgctttgtttggtttaaataacactgatgtggtttttttttttcatattgttacatcttcccgattccagcaacagtttttgatagagaatttcgcacagtttgattgaggacctttaaagggaatagtccacatccaaacaagtgtaagttctgtgaatccatctctagaatgcagtccactgtcgtcatgcagtaggactcagctaccaagaactgctttatcggttgagaatttggtggaagttgaggttttaaattatcctcaaagcccaggttcacaagtcactgtttttgactaatcagaattcaggcaagattagttatgcccttcacaaatcagggtgactttctctagggcccagtatccatctgatgctgtctctgctccctggagaaaaggcccagaggcagcttacagaactgcaaaggtttcctttggaggttagccgaaaggttttgtcttcttgtggctgctgaagcattagcatcggttccttttctagaagagttctctgcaggttgatgtattgtaccttctcagaggggaacatactcttctaggtggagcatatcatttcatcctatgatagacatatatgtgaaggccacagcatgggtgagtgggacaatggtcccccaaactgactttcttgggccagggatgtggatcagggaaaagtgtctgcccaacatgggtgaggctcagggtttggcgcctggaacctcaaacagctaagcatgttttccttctagtcttctaatcttaaatcctagaatagcagtggagaggaacatggtggcttgttttttaatgttaatccggcaataagaagggagattttattctgaagttaaagcatacagaggggtgtggccgggtcatctcattaaagatagcctgctaacaaaaactctgaggaaaactgaagggacaaagaagctctgcaaaataggtaacagtatgaataaatcaaactaaaagtgatgaaggggaccggtggcaaaagctttgtcaaagacagtcacatgatcgtgaaattgtagttaaaacccgaagcttcagtacttctaatttagttgattttcttatgtctccatcctgtcggcgcaattgggcattaatctagcagaaaccacattttctgtagcgcatgggaagtgccttttaagtcttcaaagggaacatggggagtggggccacactgcgttataaggtggtaggaaataggaacattattccctaaccactacaacacgcaggcagcaagagaaggtgtttatctggtaattacataaagaggatttctcatccagtgattttttttaaagatgttctatacattttttttcatgatctggcttaaaatccttttattcatggtaaatatgatagtgagcaagattactgtcaaaattaaaaaccgttcactccagacatggttccgaggctggcatccctgcgggacagctgcgtgctcagggtcgcccattgtgtgctccctggcttggtgggcacggccacctcctctcacattgtcttacttgggtagaagcgctggtcatggcattcctatgatccttgagaatccttgagaacctgtgcctctatgaagtcatttccacagccagtcgtggggcagccagggcgatgactcagccaataaagggcttggtttgcatgcaagaggacctgagtgtgagtcccagaacctgtatgttaaaagccaagcatggtggtgcacctgtgtgatctcagcactggggaagcaaaacacagcaggtggctttggcttgctggccagccagagtcactcaccgagtaagctctaggccaatgagagaccctgtcttgaaacaaagccaaaaaaccaaggtaaatggcacaggaggaatgatgactaaagttgatctctggccaatgcacacacctacatgctttcacccaccacacgagcatgtatacatacaaggcaaatctctattacatcttaatttctagaataaacgtgtgtggtttgaagagaatggcccccataggttcatatgtttgaacacttggtcctcaattggtggaactgtttgggaaggattagaaggtgtgtccttatcggaggaggtgtgtcaggtgggctttgaggtttcaaaaagacaagctattcccaggatgctctctgcttcctgcttttcaatcaagatatgagctctcagctgttcctgccaccatgacttccccatggcatcacagactctcaccctctgaaaccataagcccaattaaatgctttcttttatacgttgccttggtcgtagtgttttggcacaataatggacaccaataaaacatatgcaaatttttattttaagacacaaagcattatacatttacatgtgtggtagtacacaagcctgagcagcttcacatgttaggttgacacatgtgtgtacttaacaaacatctccccacatcatgagtttgaggatgctgtatgccatagaagaaaattcaagtttctgagatgggcagatcaataagtgtttaaaaacacttgcacccaaactagaggaacctgatttcagatccctagagcacatggaaatgccatgtgggcatggtgacccaggtggcccacctgcaatttcagcctcaaaagatggagacagggaatccccagagcatgcaggctaggaaggagagccacaccagtcagagaccctgcctcaaagaataagggggagagcaatagaggagatccccaacatcagcctcaggcctccacatgcatgtgagcttacacaaatatttttcatatatgtacacaccatacacatgttcccataaagagaagaaaaatagtgaaaaaattcagtttcaggaaataaaagatttgtcccatcaaagcttcaggaaccagtcctcaagtcttggcatgcactagggatagccactgttctcccacagaagcaaaaatactgttagctactacactcgggcaaccaggctttcatcagtctctgtagtggtggtgttcttggtttctctacctgacacagaggtggtttgactggatgaagagaccaaacgtgacccttgccagagagccctgacatgaagctatggcacggacttgtgttcacactgccagggtacctcagctcacaattcatgttcctcactgttggtcccaaatggcatcagataactgcagtcaggacacagccttgctaaaaatagaacacagtgatacccaggtaccacccagggaggctgtcacacaaagcagcagatggtctccctgcagcagtaccgtgtcacgggctctctcgggtgacaaagtacagatattgtgccagcctttgcaagctctgatcctagacaaggctatcaggcaggcacgcagagtgtaatggatagggatcccctagccgacttggaaggcagcgagcgggtacatatgcctgaatgtccctgattcagcatggcaaacgatcctttccagccagtacacagacagccattgtatttattttcctgaggagccagagagttgcttaatgagcagaggttggaagcaggggagcttgctggctgtatgacttgcatgtttaggagaccggacagataagttgctgtgaccacctccttcagcacgggtcccctctctagcatgtagacgagcccaggaatatgtgtatcctggcgacactgtgtgcatcctgagacggctgcaaacaactgagcgtgccttggtgttgtgaaatagagttcatcagtctctcattaccggcatggtgttgggtacctaccctggatgcagccatcacagcacactggggtcccatagaatgggctgtggctggtgtgagtgagagggtaacaggagggtccgtttcatgtggttttgtgggttgacatcatgcaaaatggaaatctaagatcgtcctgcttaatctgatggcatacatcaaaataatttgtttcactttctcctctggtcttatcattaaatgctgcacacacatggagtttgtactgccagacaaatcttcctttcagcgtgcctaatgaatttgttcatcagagtcccctgatgacttgatggcagctcagtgctgggacacttgccttgtgtgtctgtcagtggcgggacacttgtgtgcatgaagccccaggattgagtcccaaagtatgcaaggaaagataaaaggagggaaagggattgagaagagaaagaagaaaagggaggggaaaaggaagacacttctaaaatcagaatactctgttcctgttgtgctaccttaaacagacctctatctagggatacagtcactaaggtaccattattcctggactaatcagtaatcgtatgccatttatatgatcacagacagggtgtacagttgtgtcatcaaatcttcatcaggtctttaaacaaattgaaagtgagttatgaggcgatggggcaagttggggtgaacaaagcttatcctggagaggggaaattgcaccatgggtgataaaatccctgagccccgatggaggatgaatcctgtgggcctggcaggtgttgccatgattccagcagacaagaaagcttctcagccaacaacccgactttcaacacagttaaactgaggttgtcgatggcaccgtgtaggacaaacaaatacatgaattataaaaatattttaaaagggaggaagaaaaactgaaaattaattttaaaattcattttatgtgtatggttgtttccgtctgcatacacgtctacacatcacatgtgtgcctgatgtccatgaggccaggagaggctgtcagattccctggaactggagttacagttggttatcatccaccaaatgagtacctgggaactgaacctgggtcctctggaagattcacaagagctatgtctccaggcctgcaaaatattaaatttttaaagtgtcaattacaatgtctttttttaaaaaaaaatgatgatggtcacacaaaaatggggccaattccagtaaagtctcagtggtagagttgagaaacagacatgtccttgtctgtctggtgaggcttaccggctgaaggacagctcctggagagctgaagaaaatgtgagttccacggggtatgggaagtcttggctgctaacacgggagagaggatccattttccattctgatgataaaatttaaatcctaataaatcctatttgtgaggccactaaagagccctgtcagctttgaagtgggcgtgcattcacagtctgcatacagaagccacaaactgggccaaagcgcagacatctcctagaatctaatttctaagcgtgacactgtggctccaaggtctgaccttccattgctagtcactgtgtgaggacagcctaggacccacacagggctcagacttgtcatctatcttggtgacggccaatggctctctgaggcccctctggggtagcctgaacggtaaaggaggaagtgcagggggattcctgtcatgagcctccttccaaagcagtggtcccaacacgtgaccatgtcaggtctgactgaccgggcagacagccctctttccttaggaagcataaccacaggcagcccttaaaacaatggagacaaaagtagaatcctcccacaccatggcgagtagatttttgaaagtgtagccatgaggaatttgcaaaactggtgaaactatttaagggacatcttgaaatgacagtttttttttttctttttttgagtacaataccaagttagcaggcagaggggtgcggggggggggggcagggtaaatgaagaaccctccgaaagtcccaagttgcaattggcatgggggaaattgcagagcacatgccagggtgagtccttgttcaagtctctgaaaatgtgttaatttcaggatgtcataatcccctgaggaggcagtgacagagtacacctcccactcactgggtactttgccctaaccatatggtgccacatgacatacctacgctgcctgtcccagctccgcctgcttctcctcccaccagaggcatgtgaacgaaggctctcttcccccagcccctgcacgaccccccgccccagcatgttcttaaatcctggtaggagccctgaaagacgggtgctacctatccactgtcagaaacacagtcactgtctcctatcaaacactgcttgagcagcgaaagtgggaatcacagactgcctctccaacactcttagctcggcacaccagacggtcctccgtggctcaccttggttcctgtttgtgtggggcaggcgggggctggaatataggaatatagggaaggagagaaaagcaaggacggaacagcagctcacctgctccgcatgccccgtcagaaagaatgagaaatcacaacatagatatgcacaccgtccttctgtgtgtttgcgtttgtgagcacttgctggcactttgatttttgaggagtaccagcaccatcagttatgtgtaatgcagagaattcagtcctgacaagaaaatgggccacgcacacaagagtaactagcttaatcctcaaagctctggcaggctaatggatttcaaattggccctaactcgccaggcagaatggagaagggatgaaagagactgtagtgagcccataacccaacagcatcttgttcctgttcaagatttaggaggaagacaaatttgagaaagtaaacaccttttcaaggagcagtgcacacatggagaaacccctctgccttgtgggatggtgtctgagctgcaggagctgctgctgtgggcctaggcatcgctgccacttattagttcctacctaagggtcaagtatatgaaacccaagtggtcttagcttaaaaaatggaaagcttgtttgtggagttggaccaaagttggaatcacagagtctatggacaatcagtggacacttccatgtagcatgactgtgaaactgctctgtggcacagcgcgtggctgtaattcctgccttcctgcccacagagcctcatgtctcttgtgactaggcatattaaagtcatgcccagcttgaagtcattattcaaaggcagctttctgcttctggagctacatacaccatccccttcctcccgcctgactggtgctcagtgaagtccagagcttgggtctctcccattatcctacttggactcataacttctcgccttatgacagctgcctgatgtcacctgaggattcgtggttcaccgtgttcaaaccatgaggtctggggactcttgagcccgtctgtcacttcacttgcaacagtggtgcttttctcttcattccatgaggctctgcaaattaattttatgatgggaaatcatagaaacagagttagaaacacagagcccagttcaggatggcaaccaagtgggtctcatgagagccccactaagtgccaccttatagcactgaatctgggcaaaggggtgtccaatggttagttgctactgttgtagtacagagttcattctgtgttgcctctcattagcaacatttgaaagccctctgccaaatttcactgaacctccagcgttcttttcctcctcttcaatactggcatgtgttcctgatcttcaataaatgaacctgtagcataccctgagaaagtagcccaagagactccagttttaatagtctccgtattgtttgtttagaagccagacattttggagctggggactgaatacagggtgggtttcttgctgatcaggcaagcacctggaagctgagccaccttccaactttctgagtctcaccaagttgtccaggttgactttgatctcattctgtagctgggccaggccttgaacttgcaatccttgtacctcagcttctggagtagccaagtatcagtgcccccatcagacatggaaagtcacccagtaaaggcagaggaacaaaagattcccagagacccaacacttggctcagccactcaaccttctatgggcttgggcaaataatcttgacttggtgctgcagacagtggagtgagattgtagcatccctgctctatggaattgaatgtattggccataacatgactaaatgccaaatgctcagaaggcaggtaggatctgttgttctgttatagatggttagaacttctttccctttagcttacaggcaggcaatgtgtcataaatgctaatagctttttaaaaagacaaattctaaatgttgggttggtccaaaccattctcattacttcttagtctcatctgacatgacaaaacatgctctttctgtggtagcaagattgtggtcagttctgaaacaggaggcctgggggcactgagcccttcagtcacatctagaaatggagtgagttcagggattactaccatcatcgccggtgtgtatgtgtgtacatatgcgtgtgcacatacatactcactgggtttgagctctgtgattcagtgttgcttctagtcttaactctgtgtgtttgttcatttgccaggctcagggctatttgaagcaatttgaattagagccttttcttgcattcatagctcataaaatgccaggctggaaaaggtatggacacatctaaggcttctggtttcacagatgagcagcctgagacttggcgagtaagaaacccatttgccccataggatagatggtttgggctgtgaggaagtcaaaactcagatatcccatcttttcaaccggtgcccttccattgcccaaacactagctctgcaatgtcaaatgtgagcaccacacgggtggtctctaagtgacactaacagtgtcaacattaataggtcgcgctgacccaccattattaaaaggacttgtttttactcctgtctattgctcctccagtctcctagacagacaggcgcactgttataaaaattagccaaagcaggaggattatggatggtacatgaacatcccagagaaaaaggtcagttcatctatgagtcttgcattttagatgccctgagaagatctgcatgtcactaagttattaggcggatcaacccgcagcctacgagtctggcagctaatgtacttccctgactttaggctaccctgtggtcacacgtcttcagtctagtgaaatgaggaaatgatttcacgttgactagctagcatcagcctgggaatcgaaaagccatgagcatgaccacaagatgtgccgtgtaaagtgaaatcagaccacggtgttagcaggcaggcacagcactggttagcaggatgaggaagtcgcccaggctaccaacaggcctgcagttagggcttagggtcaggtaacaacctgcctttccctccctcccacagagggaaaaggaaacttccttgcaaaaaaaagtagagagagagggatatctggctgttttgtcacaaactgatttcaatagaaagaagaaacagcatatgcagtatttaaggttgttttcgtgaaaacagcaagctgcattgatttttaaaaatctattttttagtttaattctcctataaaaatttgtgttagttctttgagagttttcctagatatctcaagtaagacatgcagtcctttgcatgtatgccctagacaggtctatcaggataacacggtagacctattatcagcttcttggaggcactccacacttgattccatattggctgcaccactttgcagtcctccagcagagagtaagtgttcccgtgcccaatatccatgccaccatttgtcagcatttgcttttttgattttggcccttttgactgggcttaaatgaaatctcaaagtagttttaatttgtgtttcttgatggctgtggatgttgaatatttttaaatgtttctcagccgtttgcatttttctgaatgtttagctttgtgcatccccatttaaaaatgagcttttcttaatgtttaacttttgagctacttatatactctagatgttaacgctttgtcagatgtatagcaggtaaagactttttttcccacatctacagaccgcctcttaatttgagtaatagtaccctttgctgtatagaaacattttagttttgtgaggttccatttattaattattggtattaaagccttttactatcagggtgctattcagaatgtcttgtcttacaccaatgagctcaagcctatttcccacttgctccccttcagatttggggtatctggtcttgtgctgaagtccttaattcctttggagtagagattttaagggttgagtgatatgggttaagtttcatttgtctactgtggccatccagtctgacaagtagcatttgttgaagatactaagttctctccaatgtgtatttgttggcttttgtcaaacactgggtggatgtaggaatatgggtttatatgtgagtcctcatttccattcatcagtgagtgtcatgctgctttcactggaattttgatagagattgcattaaacctgtgggttggcttttggtagggtggccatttgcacaaatctttcacttctttagttagacttggtctattttatttttcttgaggctattgtggatggtgttatctcctttatttctttctcagtatgtttgttgtttgtgtctatgaagtctactactggttttgttttgttttgttttgtttttttttttttttttgctaatttgctgaattgtcaggtgtaggagtcatccagatcttttacatatagaatcatatctacaaaaatactttgattttcctttcttatttgtgtctactttatcttcctgctctagctaagactcaagcactatgttgaacaggggtgggcagagggaccatcattgcctgtgcccctggttttggcggaaatagagtttttctctgttcagaatgatgttggctgtgggcttcctgtatgttgcctttattatgttgagaccaccccctgtaaccctagcttcaccaggctttttattgtgaatggatgttagattttgtcaaaggccttttctcagctcgggaggtgatcatgtggtttctgtttgtgtggtggattaagtttatcaaaccatccctgcatctctgggatgaagctgatttggccatggtgaacaatctttctgatgtgttcttgaattggctttgtttcacgtctatgttcatcaaagattctgaccttattgtttcggtgtcagaacagtgtggttcataaaaggaattcagaatgttcatccttttctattgggtagttttgtaggatagtttgaggagtgttggtgttagctcttctttgaagttctcatagaattcaacaatgactccctctgacctgtgtcttatagttgggaggcttttaattactgcttctacctcaatgggtgatgtgggttcatttaaatcatttacttcatctttatttaggtcagtcatatatatctagaagttcatccatttcttacattgtaaaggaaggtaaccatacatggactatggatatagatggttaatttattaaggggaaatcatttacacgaggagccgatgacccaaatcggcgctccaagaatccagtctcagcagctttccaaacccatctggaacccagtgagaggcaagtgcccctctcctcccatctttaccctgcaagccccttaggcacctgtggccatgcccaaacaggtgtggtcagcgacacgggtgtgtagaggtctctcctacattacattttccaatttggtggaatgtagatctttaaagtatatttgaaccagtctctggatttcttcaatgtctgttgtagtgtctcccttttcttgtttaatttggatactctctaattcttttggttactttgatgaagggtttatcaaccttgtcactctcttcaagtaactttcttccattgatcctttgtgtttattttcattctatgctgttcatttcagctgtggttttgagtatctcttccaacctatttcttttgttgtgtactcttatttttctaagaataggaaaatgcactgtcaggtgcatcttttagtttagaggcctctcaaagtttttgatgtaagcacataatgctgtaaactttcttcatatggtgactttcattgtgtgctatagattttgccatgatgtgttttcatttttaatagtatttattattcaatttccttcttgattttatttacccaattttgattcagaagggtgttgtttagcatttataactttgtatactttctgtcatttctattattgttgatacccagctttattttagttattagataaaattcagaatgtgatttcaatttccctgtatttattgagacttgcattgtttcctaataggtggtctattttgttaaaaaaaaaaatcccataggctaaaaagagcattatattcattaatttttagataggatgttctatagatgtctgttagttctattgatttatgatgtcattgaactcgagtttccttcttttgctgagtgacctgtatgtccatgagaatggaattgaaatcaccaccatcactgtgttagggttgatctgtggttttatgtttaatagttttcttttgtgaaatttggtgctccaattttagttcatatgtgtttaggattgtaatatcctgttgggtttctcctaaatgagggtaagtattcctatgtatctcttctgattagttttgacttgaagtctgttttgtcaaatattagaatcactatgccgcttgactgttccatttgcttggatactttttcccatacttacactttgaggtggtgtctatcactggtcctggatcctgtttcttggcaacagcaaaaagatggatcctgttttctgatccagtctgatagtctgtttctagttgttgggaaattgagatcaaatgaactttattatcagttaagagacactattgaacaatgtgtgtcaattcctatcattttgttgattttatggtgtctggaattgtttttgtgccctcctacatgtttacccttttcttcagacaggagtgttctttccagtttcttctatagagctggattagtggtcataaattaaatctgatagttttgctgggaacagtcatctacattggcacccactgtctttcatagctcgtaagagtacataggtctagtcccgtctggatttcatagtctccattggaaatttattggtattctaatgggcctacctttgtatgagacttgactttttttcttgtcattgtaaatatcctttgttttgtacatttggttttttgactattatgtgatgtggggaatttcttttctggttccgtattagaccttgataggcatctcatttcttaaattatgtattttcttttccttctatacttattattccataggtttggtctttttttatagagtgagttcccacatgttctgttcttggggtttggggagggatttgacatttcctttagttgagtgatctagttcctcacttcgtcctcaatagttttacctactccaatctattggggaaactttcatgaattcaaacaaattcagaggaatttttcatttcaagctttattccatttggcttctcttcagagatggtatctctttactaaattctgttttcatgtcttgagttgtttttgttatttcatccaactatatttctacagtcttcaatttggcatattcatctcctttgaattctgggatcattttttttctgtttgaatccttatcttgtgtatcatctaagtcatttttctcaggggacattacaatggcagttcaaacttttcattatttatgatgggatctaggcatctggaataaggtcattggtagtgtttgttgtagaaatcttgtcttctgtgtggagggggtggctgaagctctgtgtcctgttatgccagtttgtcagatgatttaccactgacgctgagggctcagtctttggcaattcagtgttgacgttcaagtcgggcatcagaagtaaacttggctcagcttgagctcagtgagatttctaagcccagagaagactttctgtaaagttagaatatgttcatagcccagtttcaggcaacaggtactactggagacggacaagctagtcttgaatccctctgtgaggaatggggtgagcggaggcaggcacagggcatgtcctccttgtgcctatggtgaccctcctgggagagggttagtcttagggtcatgggtatgggtagagatggcagtataaagctagtgcctgcctggagaagaggccaagagggtgcagcagagataggtggggctggaggtgagagtctagactccctgcctagggacaaggcacttgggacaagggatctcagcctttcttaattttaaacactggaaaattacctatatatccatttcagattatggttggttgacagtcaagaagactagccaggaactacccaaagggggtaaaaagagagaatggaatccagaggacaggaacagactctcttttctccctggcacctccttgtctttgttgtctgtgactgcctgtggtttacaaaggacgaggaggcccaggctgggtgctgcttaccattgtctcccagtgcctagcacaggcacaggagtcacaagcgggaattatgaaaggaatgagcaaacaaagagactaatgcagacacagagtggagaatgagagtcccgtggcccgggcagctccagcagagtctgctgagagagagctgccattgtttcctgaaaagcaggcagccttggacatgactgacctagctgggtgcctgcagtgaggacatcctcaccttccctcacttgtggcagtaattgctgtgtctcccgggatcatctgaccctgtgtcacctgatgaacctcaacatttctgcccatggggaactccctttcttccaagtcacatgtgccccgttaccctcctctacccccaccctgcctccatgtctcttctgaccctgctcatgtatgtgtgtgtacgcgtgtgtacagtatatgtgtatagatatgtaagggtttaaatctagctagatttctcatatgatagaaacacaacgtgtttatctttgagcccagattctctcaatagtctcagtgccgcccacgtccctgttctcagacacaaagaacagtgacaccgtcagcctttactttcgtcccctgagctctccctgtcccatctcctctggtggccacctatttcccaccccagaagaagagctgggacattctgagactctgacatggagaaatgatcacttttggcctccgagaaaagggtgcttttccagccaagctctcctctaacagctgggggggggaggtagggatgtcatccttgtacattcatctcagctgttggctgcccaaaggctgcccaaagggaccccagtgactagctggtcactttcagggatacatcctaagaatcaggatgatgttgaggttgctgccttcaccatgttaggtacaggtctgtggcaggaaagtgaaatcatcatcacccccagcttcagttcaaagctcccagccagggcccaggacagggctcactgccaaagctgaagatctgagtttgattcccaggccccacatggcataaggaaaaaactgactctggccatttgtcttctgatctgctactactactacacacacatacctttgatccctaaatacctgcctgtaggtgtggtcagagtaactgaatctgtcactctaaaactcagaggaagtgatgaccctcagtcacttttcctgccactggagacagggaatcgtgtgccccatacacaagaagccatgccaaggaccagtgatgtcaagatgggagtggcagtccaaacacctcgcctcactgcactctggggaaagagagggctctgatggccctgtggttgggaacccaggcagagttttctctggacttacctgggaggggaggagttgtaagcaagaagctccctgcaggggtgacagaggaaggtattcagaagctggcccccacgatctgtggtgcaaagacttccggttcccagctctgacatgggtaattaatctgctggagatgggggttacattacaatttgcagagtaagtgaagactgaaaaatacaggctaagttacgcacactgactctatggtgttcaccagttaggaagagtttctgagacttaggggtgtctatcacaatggtggggaaacacacacatacacacacacaggctgcccagaaaataacagaagtggcaccagctattgccatctggggcaatggcaccactgtaacacactgcttccacagggagcagacagtaggaccccaggccacgcccttccactcccctcctcccccacatggagccgggggccacagaactgataaagaacctcagcagagaacatgggcaggacccaggcatgggcgggcacagttcatgcttttcctatctcctgccccccccacccaacaaacacacactgagatccgatcctgctaccttcagacccatcctccatctctggatgctggcttcatccaggatcacctgggagtctggagaagtcatcgctggggtctttcccagtccatgaggaccaatgctgcctcttcttgcccctggccagaggaggatcctttggtgtatatgctgagagactgagctttgggatttgtttgagacagtgctgctttgtagcccaggctggcctgaaattgacaatatagccatgccggccagtccccgcctcagcttcagagagctaggattacagatgtccaccaccatgcccaagtgagaccacaatgatttagatttcaataataataaatgaccagaaacattctctgtagtgtctctggctccggcccacactcactacccagttcctgcatttcttttaggagaagaatctggactggtttcctcggatgcgggccatgtcacttgtcagcaatgaaggtgacagcgagcaaaacgagatccggaacctgcaggagaagctggagtccaccatgggtctggtgaggcagctatctgggcagctggcagagctgaaggagcaggtcagtgagcttcagtgagctgaggtggggggggggggggccccgggaccccccctgccactgtgagcacggggacccagaaactccaggaaaggaattccccaactgtgctgtgctgcggtggcttctggtggtttctcagcaagcagggactcccccacctcctgtgcagcattctcactggaaagacagggaggggcccatgttgctcttggtgatggatcttatttcctgcctggctttggatttccaagcttgttggaaaggcagacattcactaaaagctgtcactctaaggtcccgatcaacccatttatcacacgatgtcctcagcaaccgtaaaacatgatatcgccaggcccgttggtaagctgttaaatgattccagcaacagattgtgtttcttacaacaccacttcctgtttcctaagcatggatagaggagttggtctttcttctcacttctgtttctggtagtttacttaaaaaaaaaaaatgcttttgcggtgaatatattctgtgtggaaccagacagtggggttcttggggtgaaaaaaaaatcaaggaaagcagctgaaggcacacactttctctctctttctccagatgacagaacaaaggaagaacaagcagaggctgggcttccttggatcaaacacaccccatgtgaaccatcacatgccaccacactgacaccatgggggcacgccgtgaccagcctttcatcagatgcctgcctcgttgctgaaggaaggatgagatggagggagcaaacagtggctattgttgagaagctaaaaacagccaagtgccaagatgctgagccattgagctcccggaacaatccgtaactgtgttttcacgcttgagaagactcaagctaaaaaaaccagcacagggcacagactctcagtgcagcaggaaacaaccaggctgggggggagcagcagactgctcaatcgatgggccttgggctggtctctcacatgctgtctgcaacctggagtccggttagattttatttcttcaaattgtggcacacaggtcagagacgagaagccacactcggctggtggccgagtctgactaagaaaaaaaattttaaagattaaaaaaaaacaagacctgaaaaaggaatctctgttaagcttctgaatcttacatgtaaccggacagtttcttcacgacatgaaatgtgacgggctcagagctctacacgcttggtgtgctttgaaggttcacaccccacacacggaaaacataactggagcagggtcgctttctcccggattctgtgcagggctgcacaaaagggaggtttcatagaactggctaagagtgcgcttaaagtcacgtgaatgccaagatcatgaaagtggagaggcttgaccaggaagcagggttgagcacagatgctattaaaatatactggtattaataaaggaaacactcaaagggacagagaacattgagaaattcctctggtggttttgcctttcacaagcatggagtaaaaagcaagttgatttgtacctgtggtgcctgaggacctgagtgtttgctatccctgcagcggtgggagggaaatctaaggactatattgaatactcaagaatatgcaggctttcaatggctgttacagtaacagtttgtcaaagtgtaggcaggatggaagttccttcccccaaactgtttccatgttgaatcttgggaccagaatttatgtagggagagaatagcctgggtagatacattgtttttggagactatttgaggcgttagagacagagatgaggaaagagtgaaaactgtggtggagggccaccagccatgacactacattctgagcctctcagccaccaagggccacgtggggtttgttacaacaacgtttaaagctttagggggcttcaaggcagctttagctgttggctcctaataaataaaatcctggatctatatggactcactgtgcagctgggaagcctgagtggatccaccttctacttcatgggtctagccttgggacccagtgagaggcactgaatttactcaacctgcacacactaagaccatcctaaaataagacatgctcttggacagagcaggacttctcttagcctgaagttggaggctgctgacacccatgacctaaagtgttgtgagctaattcagtgcagcactgacctttggcccttgtcagggatctgctgcagttacccctaattctttgatagaactttaacgtataattaccaacttttgtctaatggtgccaccaaaattagactgaggcagccatttttaaaaacccaaggctatcaatgctgtgacagtctttgataaaagtccagtacactgggcaagagaaaggggcggaaactgctgtgtggtatgtctgacctaacgtccaagccattacagcagctcactgtctgacactatcttctcctgtgggaaatacccagaagagatttctcctaataagactctcactgtgtcaatttttttcagctgcaatttttctttctttcccctctacaagataaagactataaaatgaaatttttaaagaaaagcaaatgaaacaaaaggcacttttctaggacatggaattcataaagatatttaaaaatgaggaaatctgaagtctggtgagagttttatatttgttatgtgtgtttgttaatgcaaactggattgtttgaagttgagtatacttggtattctcatatgtatatagcaatattaaaaacacagtcacctctgacttctgtgctagggagggtttttcttaatatttaggttattaaaatccatattgattaaaagtcgcagctcccactgaataatatttttaatttacaaaagggtttgctctcctgtgtgttccattctgaggctaaagagtttaatgaaagatgttttctaaattaaaataatcattggggagtagagatcttgcactatctagagagaatattgaccagttgtgtgcatgcaaagatggtatttcctaccctttagaaagttaagttacaaaagggcttattttcctcaatctgccattttttgcctgtggataaagattgcaatttttggtagactattgataatttcagggagctaattcatttgaatcaatgctgatattgtgttgatccccgtatctccaactcacagctcaggcttttgactgtcatttaattaccaactgtaacgtggtatgacccaccctgagactgagtgtgagtaaggaggcctggaggttggtgatgaagactagagaggggacttcacttcccagcatgccatgtaaccgggaaagaagcagctcaccttcagggacccagtcgcttgagtaggtcaacaatgcatggggttgatgacatcacatctcagagcctgtaaccatgcagacagccacactgtggaagagtaaacagaaaatggcacattcctgacagccactttaaagctttgttgaaagattctatcctggagatcccttccaaaatagtgtcagatgcaatacagttatcacctggagggagcgggcatcttcaacccagacacagatggctgtaggagccaggcaaagagctagcaaagctgtgcacatctctgaggctcctgccctgagcaggggtggggaggctatgtaagccaggctaagcttctattttcaaaatttgacagccaattccagatttcagaaaatgctggaggctacccgaggccctgtactcactcctctgctgccgctttgaaataaggattgataggactcctgtgtagaagacgacaccatgctcaaaccaaacagaactgagtgcatgtgaaaacagagctcttgtgatcagctctccgtcacctccctggagtgttcccacagactcaagcagttcgtgaagtgactgtgccagttcttacatcaacaaatggattctctttcctctagcaagagagaatgtctatcttgtcttttaaaaaggtgattttaacatactgtcagggactggataacttattagttaatattaataaaaagaatttgcatctgg

SEQ ID NO: 4 - DNA, 170009 bp, Cricetulus griseus
  misc_feature (17173)..(17916): n is a, c, g, or t
  misc_feature (43565)..(43690): n is a, c, g, or t
  misc_feature (48930)..(50006): n is a, c, g, or t
  misc_feature (65976)..(66033): n is a, c, g, or t
  misc_feature (75729)..(77238): n is a, c, g, or t
  misc_feature (90975)..(91330): n is a, c, g, or t
  misc_feature (120186)..(120287): n is a, c, g, or t
  misc_feature (121615)..(121615): n is a, c, g, or t
  misc_feature (154068)..(154153): n is a, c, g, or t
  misc_feature (165432)..(166655): n is a, c, g, or t
  misc_feature (168338)..(168614): n is a, c, g, or t
atgcaagagagagccaccagcccagaccccagacctaaactcgcttctgctccctgtcacatcctcacttatgaccaaggtgtgagtggagtatatatctcactgaagttaagagtttttttgtttttgtttttgtttttttttgtgtgtgtgttttgaaaacattttctatccttgttttctcaaagaagattgggtgactccccctgtagtgttcatgcctcagttaagaattgtgaggtatgggtggggagatggttcagctctacatagtaccaacataaaaagcagaacatggcttcacacttacctgaaatcccagaatacaggacagtaggcacatgaggatcactggggcttgctggatgttagcctagctccagatccagtgagagatgctgcctcaagggaataaagaggagtggaatagaacagcacatctaatactttttcctaccttccacatgggcatggtgcaggcacactcacagaaatgaatggcatatgccacaaacaaatgaacaaatacataaactcagtgaaacagaattgtattacttgatttctaagcatgcctttgatatgttgtaatattactactactgtgactaatattaataataaaacagtgttcctgacctatttagtaaaactcctccatttctaaatgtctgtgtctatgtggttgaatgagcagtctcaatgggggagagtattagagcagaatattaatagtaactgctcatagatgtaccatcaaatgggccaatcttgtttaattcacttttcagagtttgaagtcctcatagtgaacaatgccacaatgaatgctcacagctaaattagtgagagtgaaaacaagtaagaggaataagctagaactttgtgctgcaaaccatcgcacctcttcgataccatctaggcaccatctctcttcctcttcctcttcctcctcctcattcacctctctatcttcattttgttgcctttttcattcctcctaatctccttcccttcatctttcagtcttgggattattatttctgaaagggctttacgttcactcctgctcttgagtgaaatgtatcccactgatggaattctcagtggatggttcctcctgctctgtaatctgtggctattggctgttgtctttgctgttatttcccctctttctcccagtaacatcgatcgtttgccattcagctcttatactttgcttcccagaatcctctgcctcagaaaatattttcagttcttccatctttcataaattgagtaaaattttcagctacttatgcctccaggaagtgccttactgctgatttggtggtcaaggacatcccaatgtgtatctattagactcactcattggttttttgccaatttgtgtttcttagtttttaacagatgatcttttactgttgtttcaaggatcagttttgcccagtgtgtgtgttcagtgtattacctttgcatttggtggttatgttgtctgctttgttaatgaaaacacccttttggattttcagatttattttcagttttgtttaatatacagttgtgtttgactcatattctttgtacttaattaacatcattgctacctttgtattcccaagcattttaaccattatatacaaatttaggtctgtgtacaaataatatgacttgaggaaaatattctagtgctgtaatgttcctaggcagaagtctggagaatagaatgaatgatcttggatctgcatgagtctgccagcgtcccagaatcctccttacctctcctcttcattccagaaaattgaattttctattcagaagtaaaacatgtgcatctcaaaaaccctctggtatcatataaaagctgtgctaaaagtactaaataaagaagatgaagtcagaaaaataatttatttttcaaaataggggattttttttcaaatcggctttaggaaacaaaaccttttcatatccagttgaccaaagctggatcctacgacaagcacacatacctcactagggaacctggtggtccaggagatcaggagatagcatgtcttagatgacctttaataattgggccaaacctaggttcctgtgctcactgagacatggtgaagaggactatgcccgttggaaagtaatcaacatggcttctaggatgctcatttaaaattcctttttggaagtttctattttgtttgaatttctttcaatatgagattttcccttcactatgagaattttttaaatgtaaatttgtcatatttcttgtctgtgccccatccctttctcatccactctttctatagcagtcatagagctgtctctgtcttgtgttcagaagcaaatattgggttatttttcattagaattaaatttctggggccattgagctagctcagaagttagaagccttcatttccccttacagaaacactgggttcagttcccaggacccacaaccgtctataactccagtttcaggggaacctacaccttcttctggcctctcagggcattggctgcacactgtgcacatatacacatataggcaaaacacttatacaataaaatgtaaagaaaagaaaaagagtgcaatacctttttttgttttgttttgttttttgagacagggtttctttgtgtagctttggagcctatcctggcactggctctggagaccaggctggtcttgagctcacaaaaatccacctgcctctgcctcccaagtgctgggattaaaggcatgcgccaccaacgccctgcctgcaatgcgtttgttagtgcagttactttactaatgagataatttctaagtacctgaagcttcttaagctcttgaagcaatgtacactcttacgtagtttgtagcagttgggggcacacctcacttgctattcttgttttcattcataaatcttaaagccttcttctatccatattttcatgaaatccttaaacactgacctgaaagttaagcagtcagaataaactggttaggaatgcatagacagcctcatcactatgttaaatattaaggaaactttgaagggccctggtgatagtgtagagattcagcggcttgctttgcagctgcagtggaaggctgtgcaggggaacatacatagtggtaccagttagagtactagctaccatatgtgatctgccttgaggacaataatctggtaggattgtggtggtgggagatctttgaaaagcaaggctctgcagttcttaggttctacacagagattaatgagtgacaactccttcttttcctgctcacaccacagtagcactgtcatagggacctgcatttgcctatttgacatgtgcctaaggaagaaactgcttatcctcggctgcactgggccctgatgacattatttattacagatctctaattttattcctttcctgatttccaaattgtgatttcacttcatacttcaagttgttttgacataaggtttgaatcacaagattttaaaagacctgacttgaaactccttaatagggccagtgaatagctgtcattaagaaggtggaatatagcatcatatttcaataggtgtggcatgcaaaatacccctcctgccatcgatgctctcttcacattaaatggctcagataggctgtgcctctctcactgtctttctcccttaaatctgcacatatctcatgtgagagcctggaaatttacttagtgattttatgaaaaccagactttcccccattgtatgtaagaggtctatgaagaaaaatattaaagattttccttatcgttaatgactcacttgctgtgcagactttaaagcttttctggtatttaactgacagcaatctgtatcccataatgtgaatgagattctgcactatgtgatttgttatttactcagtgaaaggaaaatattctcaatgtggtgtgctttgagctgactcttctttagcccttgaatctgtagctataacagcaagatgtttgtagctaagagcttcagtaaatacattcctgttactgcacagcttactctttagtaacttatcccaatcctagacagctttgctaactttgtatatggaaaattcatactttcaagacactagaggaactaccgtatgtataaggcctcccatacttctataatcatcactcaagcatatcacctccagtaaagtttctcttgccttagaataaagaccaaggattgttcatgcctctgtgtagcatcctcctgacaggattccaggacagttatatatgcctgttgagtaccaaagggtgaggaagacacagatttataagaactctgaatcaaaactcctcctctgggttgctcacccacaaaggaggaccccagggaaaaattaagtcaaactcctgtaagggttcaggtcttcaatttgaatgtctgtgttagttaaatatgtgggtagccattcttgtggaagaagagccagggcttaaggtgaatatccaggccagcatacacttctcacacagctttgaagtctgagtagaaaatgcactgatgctgtgtagcatgaagcattagattagccattgtgagtaatgaccatttctgcagcagcatgtctagaccacttccctagagcttctaggtgttgggattttgcacttggaacccatcactgcagtggtcttcttacatgggggattcatggcatcctctacaggatgggaaagctgtctgaagctgctggtgacagagagcatggcctctgcagaacccagttgatgtctctgcatttagtataaccctgacctacttttaaggctatggccacaaagctacatgagatcatagcatttttctggttgtgtctaccagagtatatcacctgtgtatgatattgcaagccaggggatgagcataggctatgtgattcatgtttgtctcaggatgagagtgaagggtcttttggaaggtaatagatggttttaaatctatatgaactcacaatttgcttaatgacaatacaggcgactgcctgtagaaatgtgtataaatatgtttatacttacatattggtgcatagacatagttctctgttgtctaataactgaaaggatttcataacagtgatcataatttgaaccaaaatgaggtttgtaaaagttctgatcttaaaggaacaaaagctgctttaaggtaaacacaggagttaactatctcagtatcaaccattttgtcattccagaagggagatcactcgtaaaaacacaatcataaggatgtgtgtcaaagggacataactggaacatggcagctgaagacaaagctgtatacaaagcttgtcatagtaatactattccactacaaagtggaatagtaatatgaagttgttttgagttataacctgaagtgtggcttcagacatccagacggacataagaacatgtctgaataaataagcaccgatggagaacaaatttctcatgcaaggatttagtttatgtagtgaatctcactagtcaaagaagattggatttctctagagataacagcacagagtggagagcaaagattcagcgactacaccttttcaatttccactagacaatgaaattgaatgtgcatggtaagagtcattttgatagttcatgtgatcatgacagtggtactttatcttcaaaattttcttctcagaatcatgtatagttatttttaggaattatttcattgtctgttatcggtatgcaggtatgagtacacaggtatcaataagtcctgaagaacatagcatgttggatctcctggagctagagttaaaggtgacaatgacctgcccaccatggttgcttggaattaaactctggttctcttcaagatcagagtgttcttaaccattgagtaatctctgtaactctagcacccccagtgtgtgagtgtgtgtgtgagtgtgtgtgtgtgtgtgtgtgtgtgtgtgtgtatgtatgtatgcatgcatgcacacacacacacacattaactacatgcgtgcatgtagttaatgcgcatgggtgttttgcctatctgtgtattgatgtaccatatgcaagtctaataccctgggaaaacataagatgcccttgtatactctggaactggaattacagaatgttttgaggcaccatatgggtgttggggattgaacccgagtcctctggaagtacagccagagttcttaatctcttaatcatttttctatcccttatactcctagtttagagaaagcataagactgatcgtataccaggggcgtactataaccttctgtagcacctctcaactctgtcaaggttatgcaaaacaagggaagagaaagaagttctcaggctagaagtgtctcaagagacatgaacgctaaacataatgtgatactttggaatggaatctggtactgaatatgatgttaggataaagccaaggaatctaaagtacatactttaaacttgttttaaattctcatgttatgtgtatgagtgtttgcctgcatgtatgcctgtgtactgcatgtgtgtagtgcctgtagaggctagaagagggtgttaagtcacccagatctggaattacagatatcaacttttttatttttctttcccatagtggaaaaagcaactgaattatagtgggtaaaaagatattatgttgcagttagtgctctggttatagcaaggtaaatgccatacaaacacctccacattccaggctatttctgtgcaagtggtgttctccacctttcttatgtagagaactgtttagggtgactcaaaaacagacattttctatctcaaggttgagtcattttgtgaccttggtgttcttcctttaaagtcctccagattctgaggcagggtggaataggtggaggccatgtttgagattccaagggctggctctgcatggaattttaattctcacatcccctcacacataaggccccaaaacaatgcccttgaatgatacaagaaaagtagtcagacaattttgccctttctgagaataatatctcttttaactgaccatggatcctgtaactcatcagtaattgacaatgatccacaactaacacaagaggtcagcaaaagatttcacaaaatttcctcacaaggttgttttttgttgggaaataactaaaacaagcctttcagaagatgattgcctctgatgtgtgttcatgaatcatagtctaccaacatttttgttgctgcaatggtaaacctttgtttgattacttgaatttcccagaagtctggcaagggttagccttgtagactgggacatgcacacttacagaagcaagtagcccacggagactttatctggcagcatagggacctgaacagtaagtagcattgatctttccaaggacttgcaataagcctatcattctggaataaaatgaaccagaaattttcatgaagttgacataaagtgccttaccaggataggagccttgtgcatctgccttagattcttaatacattgactggaaaattgaacattcttagactacagtattaaaaaaaaaaaaccttttcactgtcatatattttcataaaaattccagtataagttgatatcacgtgcctatcattgttttctatgtctatcacttttatgtaacaaaatgaattttggccatatatggtggtagatcctgcaatccagacaccctagaagctgaggcaagagaattttgattttgaaaccagcaaactctgcccctatttttttaatagtaaatgaagggaaaataaattagggctttaatagataactgaagtagtccgccaggtttattctgagtagaattccaaaagtatgtttaaaccacttttgaaagtgttcttgagccaaagaaaagccctcactcttcattccacctctcattctcttcttgtgttttgaccatttttcttgtactatttttcaggggaactcccaaaagatgtttttctttttttcatagcaaatgtaagagaaactctgtgcaagactagtgttaaaaaaggaaaagacttctccctgatttctgggggaggattgacggtcttaaacgggaacaagagattggggtttcagctgggtatgaaaatagctatcttcattaagtaaggctaggcaaacagctgtatatttggataataagcagggaaagatatttgaatttcattagtcttttttccttcttcagttagcaaatatctcaccttctaaaattacttcaattgtgattcacccacaataagcatgtaattaaaattgaagaatgtttaccaggtaaggaaagttgctaaaaggagcttggaaaaggctttaaaatatgtggaaagaaggcaaatcaaggagcttgtatacttatgagatatttcaggtgctgtaatgtggggaagattttaaccaagtagacttacaagttaagtcaccagtgttgtcatcattcaatcaactcattcattattgattaataatggaatggcttttgcactgaacttgactggggatgctgtattttgttatattagtctaaagggggccgtcaacaccgcatgagatgcacatgaattttgtgaggactgtggaccacagtggatatgtgtgtttttgatggagcaaaggactgctgccttactctgggggaagtgccctactatcttgatctccttattttttttcatcagagctgggaatgcgaaaagttacagtgaagcacaatgtctcatcatcactggagtatgtgtgctttattgacaccacattatgaacccctaggtccacatgatgtgacacagaatctcttaaaataagtaaaaactgatccgggcagtggtggtgcacacctttaatcccagcacttgggaggcagaggcaggcagatctctgtgagttcgaaaccagcctggtctacaagagctagttccaagacagcctctgaagccacagagaaaccctgccttgaaaaaccaaaataaataaacaaacaaataaataaataaataaataaaataagtaaaaactaagtctagtaagaagggggatcatggtgcaaactgatgtacttggtgagataatccatgcttattttgatgataatgttgaaaagtaggtgctttggtgttgttagatagtaaaactgataggtggatcatctcaagtgatgtatacaaagggttaatattcttaggaaagaccctgctgtcataatggcacccaacaaatacttgtctgatgaatgtgtaaggacaggtgatgtggatttgcagtaattaattgagaattggaaaattagcacttctcacaaaatttaaactaaattttgatatcaggtgtggagaaggtgctgagatggagatctgcagacatttacacacactcagaagaagcctagagtagcagtagagagatcatagactgaatgcctggctgtctatttgctgagcctacaagaagacaatgtgtgtctggaccctatgcatagcagtcttgacaagtggccttcagccaaggtgacagctactgcatgtcttctccaccgattaattgtcagatatctgtgtcccattccaaacagctggggagccatgctgctaggtaatggaaccaccatagattctgtttaccacttggtcatgttttcaatgatttctgaactacatctgtgttctctctggtacagtcagaattgaaagaaggaatgagaattgatatgtgttttgtatgagggacattgggatttaccctctgcttcagcagtggtgtgtgaattgtggaaaggcaaatgtcctggaatagcagcaacctttttctgttcagaaggtcaaataagagatcacttcttcaggtggaattttccataggatggcaagcaaccatctgaggtagccccatgtatttagttctaatagaatgtgtactgagcctaggaataggaagattgttgagagagtaactctcctcagacagggacttcttatcttgtaagaatagcacccaaacaaggatggagccacaactctgtttcaaacgatggaaatggctatttgccatcaaagaaagcattgtgccagagaaatgagtttcttcaaactaaaaacccatgcttcttaattatctcagcaatggctgctcgtgtttctataaaccataaagacacaccatgcaaacaaggattgaagagacttccagagatgtgtgaaaagagctgtcgaagagtagtcctgtgtaagacagctctccccactctcagccctgatttaagcagtgtttgtgagatgattctctgctgtaaatatatttcccaccatgtgtgtcagatcaggcagaatcataaaatgctggctcacttattttgactctggttttcctaacagaggacagtacaagttaagttctttctttatacatatgtgttctaccttgtatatcctggctcctttccattaaatcctcggttctattgtcagtattaaattaaagtctacagtactatattgggcagccaatctttggagcttcaaatggttttggaatttttcacctaagtaagttccagtttaagcttttcatccatggttgaatctaggaccatttactggtcacattttgtaaaaacattaaccgttattgtccaaggttctttatacttatttgtactagaaatatattttcatatctgcatttttgtgctgatcctgtgataaagcccaggggtcatatagtagatagatgatttttttggaaaatgggctgactttctatttttcctattttttgtgagctattttaaaacagaacacctatgatttaaaaccattattgagaaggttcagtggaaaatttttgtattttgacttgtttattcctatctcactgatgtgcatgaacacattatttcaaaatttgtgaattgcttcaattctcaggtaacaattataaacaaatattttctttataaaaaatgtagtgaaaatgtaaatacccatgatttttaaggaaccagaaagaacaagtgacagttctgtttacttattttatctttagcttccaaagttgaagatggaacctagggccttgcacatgctgagcaaacttgttaccagtgagctacacctctagccctaatagttcttgtaaaagtggtttaggtccagggctctttgttccatggatatcatctcattctgccaagaggtcctttaggctgttgttaagatgtttttctcctggtggatttttttctcctgcaacttttggacagcttcaaactcttatttttcttctcactttcagaaggtttgttattaatttccttttcccatccaggtaggtttttgtgatagctttttttcttttttattcctgtctcctaggccacagctttgccttctcctcactttcttttctagtcctcatggccttgttccttcaagagttttctttcagaaatataactgaatagccagactttctatgaaagaaataataaaagccaccgtaacactatcaaccatctcacctgatgcttaagaggcacatatttttttttcctcacaattcattgagaacaaagtcttgacttttgcctgtgttttatgtgaccttcctagttctctagttccatcctttcttgtcttttctgctctacaccagccacatgggctttctggctgtttttcaaatgccccgagaatactctctcttctaaaaattttgtctacaagataaatttctgagtagccttttcatagtaaaatcacaaaaagttaaaatatttaataaaaatgtaaaaataacttaaaaggcagagttccagcttatgctgaaaacatgtttgtgtaactgtacgaggaactcctgtgtgaatgctcttacaagcatctccttttcttccagacattgggaagttggccctcaactgggcatcactttgtatttaatattagaaggacttaagtttgatttgatcaattatttgctttaatttctgagaagctgaacatctggcaccacggttactagcactgcattgtggaagacatattgggagaggaggttcgggggagatgggacacaagatagagagagagagagagagagagagagagagagagagagagaggaagagggagagagagagagtccatgacagacaatgttcaacttggtaatccagtgagtcttgttggggttattaagaagggtaatatgggtgaggggttacttacaaggagtgactatgactcataaaaagcaactgcatctctgtgaagcccacatcatggatgatgactcatgaaaaacagccctggagctctctgcacaactggcaggtagtaatatggtctcatgttctctttgtggtttaaatggccagtgtctcttcccacagccattgtttactcctgtttatactattgggtaggggtcattttgggaacattccaagttactgttatcatggacatgaactttggttttccttctgcttgcatgtttctcctttcctccaggatggagtgttacaatgcaaaggaaactgccctggccctttgcttccagggattaccctactggctgtagtgcgtagttactgtgtctggtggctgagggagaatgtgggaaaagtcaggttatcacatggttcacacaaaaggacattgagaccacaaataatccagaaggtaggataaggaagaataagaagcaggtgctgaaggtatccatgaccggaatgtacccatctcatggtacagagggaaaatagcaggagggaatgctgaaagtggaagctagctctagtcaggtattatgttttgaatcttctgtattttgtgttgctttgatatcttaggaaatttcaatctggtacagactgcccttcctagagctagcttttataacaatgaagagtgtggctgggagtacatgtctcttctactgattagcctgtccacagtgcatattctagccacatcagcctccttctatatgtagttttcccatactaagatactgattttgttagccctatggcatgtcagcaccagacacagagatgctaggtctgtagtcctgagtacactggttgccatggtgctatacacagtgaatgagtttgtatgccttagatatgacatgcagttttggtaaggattgttgttttgagcttgggtcttattttgcaatggcatcactgttgggttagaaggtatggacatttttgttctgtgatagggtgactttcagctgcgtagctatgtaggtatttgtgatgactgagacatacaaaatggacaccaggagaaataaagtggatgatgccacccccagtggatggatatttgctggcatagattatggagagatgaatgtcttctgtaaagggatggatattatgatcagctttggaggaagggtatgatctgtcacaactgtaagtttcttatgtaagaacaaaattacttgttgacagcacacacaaaataagagtagctgcatgctaataaaactttgtattttaaagatacagataccatgctgatgtagtaacttgccaattcttcttactattacacaaagccagtgattttagcccaaagaatgcaaattgacaaatatgtatcaatatgctagtagttagtgtgattcaactacaaataatattgttacaaggcactgtggcttcaatgatagctaatcaaatttcctattgtcttaggagactccatgaactttggctagtatcatgacctctttgacatacatatgtgacacagttacagtattacaagaggaatataatacatacatatattatccaataattatttgtttaaactactctgcatacgctctcaggtctcattaggcaacgtctcaaacctaagttaagagatggaacagggtaaaaaatttctacacatttatcatagaataatgatttcaatctttcttgagctggagtaatccagacccagatttaaattagaccacagaatcaccaatatttgaatgaattatagcacaattctgtttttaaaggtaagaaaggacattgaccagatgttgagatggagtagaagaaagggtttatattgaacagcatattacacttgaattagaattctattgtggaagttattagaggtggtttactttcctctgtttctaagggtttctttcattaaatcatatctcttaaagtgatttatatatttatatgaatgtggttaccaacacatgtatgcaagaggtgcatgcctgttggatccctgagaactagggttacaaaagttgtgagataacatatgggtactgagaatagaacccgggtcctcttcaagagcaacaagtgctcttaaccactgaaccatctctctaaccctgttaattcaaatctttagcaaaaggagaatagaatatgggccaagattcattccttcatctgttgattacagggtgtcactctctcttgttggagaaataggcagtgcctatctctgctaaaaatcctaaatattagttcataagagacacgtgtacttaaaaacattccttgatagtccataaggaacccttcaaataaggctgaggcagtcatatatgtgtccataacatccatgtgtagaaaccatccatgtgtgcatggtatcgttgtgtgcatactatttgatttttagtataacttttgaagataatttatggaaaagcaatttcattgaaataattcaattatctattttaatgttagcaagaatccagagaaccaattggtacttctatgttcaaaaattttctgctgaatgatttcacttaggcaggtgatttgcccatacaatcacatgggtgatgggtagagagagatgtaactgaaacctgattttccagcctctgtatgcgttgtaatctgcttcacagtgtgacagtgacagtcccatactaaaatgtctgcttcaaatatgtcatgtaggaatggctctgaatcaaattctgaaatttcctccctactcactaacccccagagaggatttttttttattttactttgagctcgataagctgacagtattggagttaaacaaatattcttaggtgaacctctgtgtcttatgttactttagagcagcagttctcaacctgtgggttacaaccccttgggtatcaaatgatcctttcttagaggtttcataaaaccattagaaaacacagatatttacattgtgatttataaccatagcaaaattacagttatgaagtagaaacaaaaataatcttatggttggggctcagcaaacatgaggaactgcattaagggggtccagcattaggaaggttgagaactacagctttagaagaattggcctgtggtctattataagtaaatccattcaagtgtttgtgttttgactcttccctttaattcctgatcttggaagtagctgatacccttatgtccataatttctatttagtacaaacaaattaagtacacagtcctgtcgtcatggattccagaattcacgtatggaaaagacaacagaatcagcaattaaaatagtatgtgacttatgcccccttcctgtgggaagtatgatgtacttgtgaacagagataatcctggacaggtcatcaaatgagcagacttgggacatgacaatagatactaaggaaagtaaagaaatagggatggggtttctccacagggctaatgaaaaaaggctcacaggcagggaagattgttgttgggagagctccctgcaggtcactaggtctggcattcaggaagactgaagatgtgatttaaatgaatattgactatagaatctgttctggggagcagctaaaacatcttcaactgcatacttgggcattataggccataacaggcttttaaaatagaacaacatgatataatttgtgagttagggaaactaatcttgctgcagaatagaaagaggaggccggatggataagattgaatatgacaccagcagccacagaatactttcaataaggaaaaaaatgatgaaatctttggttaatgcaggagaatatgggaaaagttagggctgtgatacatatatggacttagaatttgttataggtgatcagctttttggtgtaggaagtgagaaaaagaaatcaaaggcagctgttacatttttagttgattttcataaaaagatgaatctaccctttgatgtgtaatcataagatttggacccagcttgtgggaaaaatgaatttattttaagcacttgaaaacttagccaatggttgaatataggaggctagaatccagacggaagacctgaacctagagagagagctttgggaaatttcaacttcaggtaatttatgaacaggtaggagacaaaccagagactatctgaggagtaggtattagagatgtacagtgatgcagtttgaggtggtaaatttaaggagacagatacacaaatgaggcctcaaagagaactgagtaccatatgctaagaaggtggaggaataccaagagaatatggtgtccttgaaactaaggatagaacaaaattgtcaaaacacttctgtgagggcaaataagatgagaactgaaagggtccctgcatattttgagatagttttatttttatttacataaggaatgtgtaattattacataagtagcatgaacatatatattggtagaaatataaaaccatgtatataatttgtcacccctaattccatcaccctggataactactgttcaaatttgatacatctttccagactttttgtatatgcaaatatatgctctgcatcaaaatatatctatatataacaaaatgagttcatactgtaaaaatacagaatggtgcatgcatttgcttatcatcccctcaagaaatcatgataatctccacaacaatctgactttggtgtatcatctggctactcatatagggcccattaaatcaagccactgggggattatttgtaacattgcaaggctaattttgttagaagggagggcagaaaccagattgtggtgggctggaatatgagtaggcagtgaggaaatggaacagggattacactggctgctcaggaggcagcctatgaagagagagcagagaatgcctaaagtagaaagaggagtgtgctgacagtgtgtgtgtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttgtttgtttgtttgttttttcgagacagggtttctctgtgtagctttggagcctatcctggcactcgctctggagaccaggctggcctcgaaatcacatcaatctgcctgcctctgcctcccgagtttgggattaaaggcatgtgccaccaatgcccggctaggtctagccttctttaacaagataaaattttagaaaatgtaaaaatttagctaccttacttaactgttagtattttagaatcacctatttttgagaagcttaagggaaaggtctattttccttcccaaagactcagggtttgtcaagatcttttgggtattttttgagaaatgtactggaaagacacaaattgcgattgaattttattagactttagattagtggctgtaaatatttgagttttagtttttctcattaaaattggagtcctgtcacagaagaccacagaacgtagaggctaatatgtaccattggggtactgctcaggagagaacatgttaccctgcattgctatcttgtgtacatgccagtcaaggagatcctggactcctgttccactctcttgtggaactacagtccacaagactagactttcctaaccagaatttgatgacaacatgtgcaactattagaaagtataataaactttgtcaatgatgagcagtcatcagtataatctctattactgcagaatataaaaatcatgaatttattggaaagtgttaactacctcaaaatgcataaccacaacagactcttacatttcctaaatgcagtggaacagatctagttttgtatttacagaaacagatctcccgaggcatttttaggttcacacactaactaagataaatgctgcagatgaccagaaggaaacttttatttttttttcctcttttaaacacaagaccctcaagattaatagggcaatttggcagtgggtatgcaagcacttctggtgttgaaatatcaatcctcacagtaaaccactgctaaataaatataattgctgtaatgcgttgtgacctttcaaatcctgtcaatcaatgggaagcatcaatgctagccctgttcagaaaaactagttgccatttgttataactagccatgtgtgtaaagaagtgctatgtgtttgtattcagttcagcaagcaagctactttaggccataaagcaggggcattagtcttaaatggtatccctatgagtttctgcaacccaaatccttactaagtcaccagcacaactgtggatttaactttgcctttaaaagtacaatatgagaatccacttgtgcttgcttcaaaatgcaaggtattatgtactaatgcagttttctcataaccactttgatgttcaatatagatcttaattatatatctttgtttttctatgaattatatttatcactactgtattctttcaactttcttccctggagctatttgaaggactttttttatagccttacctgtttgtttttgaacattttactgactggaactcaaaatggcatttattatttgctcattactttcttaagcagtctatacaacagagctccataaagatcttcaaaatgttgaggtctctctgattgactgtcctctgtctgcttcaaatatcctgtttgcctataaggatgggcatcttttgggatgactggccctagccatgcctctctgtgagaacccaattcttgagtggattccacttttattctagtattaattgctctgtctgttgctgagataaaatagctaatgaaagaaacttaaagaaagagcttgtttttgcttagagtgtaagagtacagcccatgatggcaaggaagacatggagacaggagaatgaggtgacatcacgcattgtatttgccattagaaagaggagaacaaatgaagaccagtgcttagcttgcatcttccttcattggtctagaactgcagaccagagtggtatcacccacatcctcccacctcagtccatcctctttagtaacctccttatcacagacatcctcacatttgcctactaggtaattctaactcctctcaaggtgacagggaatatcaaacatcaaagtgtttagagataacaaatcgaagatgaaactatgtgagtataattcaccttgatgtttccagtacctccttgtagggctttgcttgccttgggtagttacgcatatctacgaaatgaattatgtattgatagaggaattaaggaagagtcagaaggctttatatttaaatgatgtgttataggatgggacttatctgcttagaacaagaagtccattggcgttgaaaatcgtatttactcatcaatttacttattcatgaaagtgaaatctaaagtatactattgaatcaaagatctcatatttcttataagaatgttggcattaatttttaactcttatttgtatgtgcctacacacacacacacacacacacacacacacacacacacacacacacactcatgacataatatttacgtaccaactccagggcttaacttggtgtagctgattccctgatacccataacatttttaataaatggccaattctgtgctttccagtgtgaaggggcagaagctgtctcagatgggaatattgggaagagtcagaaaccatgtgctatcatgtggtgaagtaaaagatatatgaccatgtcagaaagtagagtgttggcttggtcataaagagtccttcgacttgttggagaaaagtattaagcaatccaagttccctctaaaggagcatttaggagaattagtttgtttgaattatatagtaaaaccaaagataacagggacagtttggaaagttttctgctgagttctgaaatatgaatgatgtgatttcattgaattgattacattgaaatgaatgtggaaaattaaaaatacaattgctgcacatggaattctaatttatggaaggttagagggacagtggataggttaattcctaaagtagttattctctgattaatttatttgaagttatttttggaccttaaatataatcccacaaaacgttatctagaatgccagtatctctggctttggttgtgtaatctgaatttggattgtgtaatctgaaatttggttgtgtattctgaattgcatgattaggactatgtaaaccttcgtcaatggatttggtttaagaatttctgttacatgtggagtgttggaggcttaacatatcatatagaagtagatgctactatctgtacttcatgtgcatctctagatgaatggaaagaaagctatactacaggaaaatatttgtttgtgtttccaatattaatataaataagattttcattgcaatgagaagccaggaaatgaactagacagacagtggaattcattttcaatttcagattactgactttctattaggatattcaggagtagtaaacttctatgaagttagtaaatcatttccgaatttatgagtacactattataagtctaaacatccactagaaaaccacataagcaaggtaaggacataggtagttctttttaatcgtcaacctctagattataaattattagtattacctttccaactaaaaacttgagagcatgtagcttacttctcctatcttctcccaatgaagttttacttcaagagaagaataaggaggctccaagaaagatacaatagttcaattccttttattttgttttttttctcataaatcattaaggcattgctttagcatgcagttgagctttgacatgaagtgttatatagatttttgaaattactcgaatgttatttttgttttgtagaattcttttagtattttgttaaaccctttgactttgccatcaacaaagaacctgcataaacctgggagggagtgttatacctcactttaacagtagcagattacttgcctcctttccccacaacaaagcaaagaatacctggaaattgcatatgatttcaattttgaatgggcatggtgacagatcctataattgcagcagctacttgcatctcaggttagctttcagttcactgatccagatctttgaatggctattatatagaggaccctgacggtttttatgcaaaggacaccttgttgtcaaagtaaggggatgtgtgtttaaaatgagcagaggttgtggaagaaggtaagcaagatatcactctactctcctgaatatggcctactctagcttagaatgccaggcatcctccctccctcccttccattcagaggtactgtcactggaacacaggtgtctgctaaaggttagcatacatttatctggcttagccacacctacagcaaaaaccttttgaaaaagatacttggatatgaaagtttcttttcgttataaacaaactagaactattacaatattccatataatataattagaaaaccctttttatagtcaccatataagggaagatgttacatcaaaggcaactggaaatgatatgatattgccttaataattcttgaagatggtttctagccaggtgtggaagtctggtctggaaacttgatacaagtacaaattctcaaccccagctaactgtcgtgaatcagaagcactcctcaagggttataataatctgtgtataaatgtttccccaggtgagttttaaggaaaaggcaagtttgaaaaccatttgtgattatttcctctcatgtcaatgaaactgtgccagaaacttggttgcttatagccacctacatttattatctcttattgacagagttaaaaggctcggatgcatttcactggtgtctcttcttagggacttcacagtctcagaatctcataaggtttcaaagtgttgttgagaacagaagacagactggatgggcagctcagggcagaaacccccaacacagcagtttcaaaatgcctccggttctcaggccagaaatgctagaagggagcactgttttcttacctcctaagtgagcaccctgtgtggaggctatatgtgatgctgggcagtaaaattctagttctgatattaaccccttctagtgaacagctttggaatctgggtcttagattttctttttaaagtgggttacatctatgccccagtttcagccatctcttacactatgtgacagttactgcttcagagtggaaaatattacagtaatgtggaatctaccaataggtggagacaagccaatgtctgcttccttaagagttaatccaaatgagcagttcaggcacctgtctaaaggactactgtcaggaatgcagatctacacattaatctatgctaaagctatgggaggaaagttggagaggtggtcagtggtgaagagcattggctgctcttttaaaggatgcaggtttgattctcagcacctacatgatagttcataccacctttatcttcactgccagggagtcctttgacttgtggccccagtgagctagctaaaagcaggcatgtggtaaacagacatacatacaggtaaaacacccatacatataaaaatgaattttaaaagacaggaataataattagttcttcgatgaaacaatgtaatattccttcccaaaatgccccacccacacacccacccacaatattttgtagacactgtgttgcttagctgggtctccttgcctctttgactcctgactcaggaaggggtagtttttcccttttcttctcttcttgtccttttggatactagccagagcttatgcacgtcctgtctctggtagtttgcatttttcggtgtttctctagagctgccctctggcaagaagtgtgcttccttgtccaccatatatctaacttccacactggcttacctcaagggctgttggttttgtttgttttggtttttcttttcttctactaatctccattgtccttctcagaacagctgacaagaattccagattgtctgctgtttgtttgcttgtttgttttgtttttaagcctaataaatttgtcctcaggcttctcttgagtttgttcttaaatcattttattagtgagattacgactcaaagagggcaggcatgtttcttcagtgttatctggcaacgatgaagggagccccaaatctttcacgtagcacaaggtatagtggatgtcaacagctttgcattcttctctagggccacacacaagactcagtgacataaactgtaaattcaagacacttaaggttgacatattatggccatgagctacttctttgactgtgctatgtcttcagtttccctttccacaatgtgtggtagtagcaccaacatcccattaaactatatgattattccctaaattacctacatgttcattatcttcaaaacctatttattatattctttacattaacttatacattttctagtattgcttctggggaaatgctgaaaactttgagaggtgttctcttacatatttttccattaaagtctgagttcttaggctcttgtcttgcaaaatttccagttttgctcttatcccagtacacgaattgatgactaggatcaaattcttataagtactgcaaagaagaaaatacatcacttttgcacccataatgattccgttaattttcagaacaaatccattcccaaccaaatgttactatccttgtttaccaggtgacagccagaatcttaaattaataagctgacttttccaaatatgtgtacagttagttatggtcacatctgtctaataaggatagatattatttgtttttattttcactttaacttacacaccagcagaagctagcctgtcctataaaaagatcttttggaattcactagtgaatggtgatcagaaagacttgatgatttgagactgaggctggaggcatataaatggaaagcaggttggggcaggcacttagataattaggaagcagtgtgattatcaaaagaacattacaatgaaaaaaggggtggggcaggggtttataggcaatttccaggaagattcataaagaggatacctacaaggaatgatgcatatcattaacctacaggacacttgaaagcatgccatggagcagctaaactcaaggtggatttttttttttttttttccggtcaggactccatccttggaaacaaggcacatgaccctctcttcctacagggatctcttctccttttggctttgcagttttcttaatctttatttttctattgtgagtaacaaagaactgctgacctaagcctcttttttaccactatagatattccactttatcaaaaagactaccagatgggctatgtgatcaccatttatggatatgcaactcaatattttaaggagaaaaatcatctcagatatgaaatgtgttgcttggaattttctcttgattttctataactctaatgtggaaaggaaggcagcccatcatcttgcaacttgctttttaaacatttcagagcttatgtccattgtatatggtattgtttcacctgcaacaatgcttaaacgagcatatacattgagcatattcttcccaatatgcctctctaccattccttccttgtccctccctgattctaattagtcctcctttcttcctactcagatacatgtcctatacacatgcacgattttatgcatctatgataaacctagcaaccacacatgaaagaaaatatacgatatttgttactgttctcactctgtatttgaagactccctgggaagtaaaataagattcctgttattcaaatcaataagaaacaaaattacttcctaaacagtcttttgtggacataatatagtgtgttaattatagaattgacactgaaatgatgaaggtgactgagactacaaacttggtgttttcttttgtgcttgaataagataactcactcaaacacaggcagatgatgctggagctctagctcccaaaattttgagatttgatcttgctagatgagtcttttcttgaatatttattgtcctattcctattggtgatgaaaatacatattatattttgggaaaataattactattaataaaaataacgaatgtttctagaaatattggtacacatcttatcccttaaggtccttaacagagaccttgtgaagtacatgtgaccatgatttttacttgaggaatatgaggctaagaaaagacaaatgattggacatttttcccaagctgaatagttgctaggcattaattcaaaaactctatgtgacatcattgtgttagctagctgctgcataatcacccatggcaaagacttgctgatatgtgatgtgtaaaaataactatgatctatctcatcacaatggtttttctgaggttgcctgaccagacttgctatagctaagcatggcagcctggctgggggtatgacttccccagtcctttttctttggttgtcatgggcaaaatgcagcagcacaatgggggatttctagctaggaaacttgactgtagacagttggctgggaagcattcacaatgcaaattccacactagcaaccaggggtggaaggaagaactaaatcttgagaattattttctgacttccacacaggcactgtggcaggcatgtgcctgcaagcacacaaagaggattaattagttaattaattaattaatgaaaacaaaaccccaacgtccagtttacatgaagtcactgggttttgtgattacctattagattatcaatcatggctatcaacatggtgcactgggaagagggaaccacacctgaagaattacctctgtcagactggaatgtgggtgtgtctatggggcattttgtttatttctaattgatagcaggagggctcagttcattataggtactgatatctatagaagagtggacctggattgtataagaaggggagctgactttgagcctggaagccagccagccagcaaccttcctctgtggtttctccttcaggcttttggcttgtgatcctgacttggcagcctttgatggtgaactatgacctgtaagctcacataaaatattcccttcacaaaatgctttttctcaggatgtttttcacaggaacataaaaacaaaatcaggacagatacttcataaatcctgaatgtcccagtaggatgatgtcctcagcaagagtcagccatattgaatatgtcatggagcagatgaccacttgtcaagtcccatgtactaactatacttatgtcttgcaggcatgtttcagcttatagcccttaagtctcatttgccctggacaaagatgatcaacaataagtcataaactcactaccttatggaaacatgatttttatatcaatgttgattacttcattattcatttctccaatgagtactttgtaaatgacagcaatgtaaaaaggttggcggtgtctgcttaattcttctcttctgtgtcttcccctgtgccattagaactccagaagtggaagccaattggtgaacctagaaaactatgggcatgatgactcaactataatttttttatggtttcatgacatgtcaactggccatacattctctcttgaagtgtttcattataagaacagtctatattgtatagaacagtggtactcagaaaaacaaggcaaatatgttcattgtagaaatagtatatctccactattaaaaatgaaaaagacaatcttacctttactggaggctcagtggctggctctgttagatcctcttcagggctagcccaaatggagtctcaaatagtaatattctggacccagctctgtctccacttccaaatgtttccgcccttttgctacctttatagtaaacagtgtaagcatcttggtagtgcagaagttattctgccgagaccctcttgtctagccctttcattatcagactaagaaagagacagtagaccctaaggaactggaatttctccaggactctcctattgggagaagcaataaactgaaacctggtgccagccggtgttcaagtttgactactacaagagatttcatacagtggtgacaacttgtcaaaagagcttgtaggtgagactgaattccagacaatggtgatgggctgaaccacattttgactagaactatttggaagtgcaaatttcttgtccactgtttaaagcctacctctcgtgataacagtctgcaggtggacctgctgtatatgtcactttgttctcagccaccttaccctggtttcacctctcacttttatgcattctctatatttatgtgtttaattcactttttgaggacaggtggttgctcccagcttgttaggacagccagggacaggcatcaactctaactactccagtaacgacaccatgcttaggaaaagcagtattgcagtctcctcttaatgaatttataacatgtcaacttttctcatttttgtgacaatatgacctgtgtagcaaagcaatgattgaggtttatccctaggggaatacgttgagtgatttgacaagcaactcttcttttatgtttagaataagaatatccctgtgaccttcaggactgggttgtgactaactctgcttctcagctcacagaatgctttgagttctgctcaggagcatttatttctcttttctgtttgaagccaggtcagtggatctgaggtgactgtgctagcatttttggttctcaccccagcacttttttttcctgtgtattactttataaagttctatattggaacacccataaaggactctgtgtgccttccttgatctgacaacttatataactagcatggccatcttacaaaggaaaccctctgtttaattggtgtgggttgcatacacatgtacatatgtttgtacacattctggtggaggctcgagagcagctgtgcctggtatttatctcagatgctgaacatcctgtctgtttttaacaagtgtggttattttcatgtgaatgtgaatgcaggtgcattagtaaagatatgtactatacatatgatatgcaagagtctgcaaatgacagagggcctcagattccctagaactgtgcttacaggctgttgaaaaatgcctgctgtaggtgctgtgaactgaattctagtcctctgctagagcagtaacaatctctccctacatcttgtttgtttatggtttgtttgtttgtttgtttttgaggcagtttctcttacttttacctagagctagtcaaagtaactaggttgtctaaccagcaatttcctaagatatacctacttcaacctaccagcttgagataacaaactcaggtcaccttggctgacattttagatggctactttgtatccagcttatcccagcctacgtctttcatgattacttcagcatcatagaaaactgacttcaacacttctggtctggctttctcacggggattttcttatcatcactgctacaccattaagtgtcctattagaatttgaaaaacaattctcatactagtcctccacatgctggacttggtgctaaccactgaactaggatcacttgtgatagtctaaggatacttttgtgtctttaaatcagactatcagactgttgagacaaggaaccccaaagaaatgggaatttccccaggagtttcatgacagtagaaggaaaattaacagtcagagtcttggaaataaatttcacacagttctaacaaattgcctggccaccttaacagaatgagattgaagttcagacaatgatggacaaaagtggatgggcccacaccttgacctggactgcttagaggtggatatctgtggacctctacttacacttttgccccattttagaattcctggatctctttaggagcacaggatctctctgtccctctttctaacatggcctcagtaataaaatcatccctccactcccgggtgtttaattggcttcttgagtacagatggctgaatttggcttcttgtggcagaggctatgacaccaaatttggtaacaatatcagtgcaacaaaaaggtatcaaaacatatgccgggagcttctggcatccttaccactgtacagcaggagaagtcccatgcccagctgcagaataccctgcctgtcagcactgcctgtggcagttgctagtgtgaatggggaaattgtaaagtgtctgcatgtttctttgcaccagcagcatgggagtgccagctattgttgttgtaaaggaacccagttctaaatctgtgtacttggatcgctgtgctcagtttatttagaacatggcatttggagagagataaaataccagcacactgtgcctttgccttttcttattttcttgagcaatttggctgggtctttttgccagacaattagctagttgtgggatataggagggagggatcttgaagaagaatgttatcatgatgcccactgtgatagacctttgtagtgttaatttgagtaggaataatcatctgtattgatttataaggatggaattgagttgtgactttgattcaaagaagaaagcaggcatgaacagtttgatttatggtagtattaaggcaaatatttcagattcagtttctgcagtctaaagttgcctgtctggtgtttacatgtcagaatacattcagcaatttcttgatgagaaatataccccagatggaatctgtaatttatttttgaggccagagttctcagctatattttgtgctgacctcttggagattggagaggaagcaacctgggactcaatcattcatatctgagagtgggttgatttggaaagagatgaataggcttatgagaaactgatggtttataaccatgcagattaccttgattctggatatagtgctgattttcaactatgaaaatttactgcatttataaggtatctttcctacttgagtgatggaaactattgtcctaaagtgtatgatatcctgaagtttcagttaagaagaaaactgccaagtggccttttgaaatgccttggctcatgcaatttgtgaccataacgaatatacttttattcacagtcactctttgtatgtctctccactatggctgtaatgacactttcccaattctccaagttctggttgtgcttttgacaatatttgccacaccaagacataattctctgccttggccatgtttagtttcaaagcataagttgcatgaggtcaagataaaagcctttgtctgaagatggcagatgaatccttactaaacactaaatgaatgacatgtttctgtagtgtcagggtcttgaaatttcttggatgtgggttcaagagggacacggatacacatggttgtgggtaaggatgttattagaagagttattcatgtcatagacaggcaggcacagacaataacatggcaggtgctcggcagagagttgaaggttcagcaccaaagacagacagaatggtaggggctttgcagaagggaatcataacccatgaggcagaagcatggacacatattcatgctgtctaatagaggtggtttcataacaagaaactgaagccagactcttggttcttaagcagcaagcagggaaaggggtgaaaaagtaggatgtttgactaccaacgttccctttgatgtcatctcacttccccaggtattgtagtttatattatttgtcactttgacacacctgagaagagggaatcttaattgcaaatttgtccctaccagatagatccctacttatgcttcgggggcattttcttgatttttaattgatatgaggtagtctaacccactgttggtgttgctgacagggaagtaatcctgagctatatagaaaagatattgaaaactgaatcaggatcaagccaataagcaatattcctctgcggtttctctgtcaaggtcctgccttgcattctcatcttgacttcacttgatgatggatagcatgtaatatggaataaatgtcttcttgctgaagttacctttggtcatagtatttagtcacagcattagaaagtaaactagaacactggataagatatccagtacttggaagcttgtctacctagagactacccagacatggcccaagtaagctacctatcagtatctgggagtgaaagtctgctgccggtattgtgttcttacagatcctacctgtcacgtcttgatatacactggaatgctaaggaatcttccaaaatatctcagttccaagaatttcacaacacagtactggctctggtttctcatccttgatctttcagagttgtacctaaaacaatcttcaagcaccttagaggattgggtgacatactcatttttgaacaccatggtcatagcaaatgtccttgaatgttctttctaatggatattgtatgttcctgcagggagcatgacttcggcaacttcacctatcattttaaaatgggatccaaaaagtttggaaatccggacactcacagtggaaaggctgttggagccactagtgacacaggtaaggggtttgttactatgtatgattccttggtgatttccatgaacctatgaggactgtggaagtcttaaagaggatgcatcatgccatcatgctgattactaagtaaatattatttccccagctgtgaactgtctcattgccttgtatcacttaaagtagcttttgagcaattttttttaaaatgaagttgttgagataattaaagagagggcccttggtgaagagagccctcaattgcaacaccggatggattcattgtctaaatgagccattcctcattcacttgcagattcgaatgcatagggaaaaacttttgactgtttcctagcagtgaatatttatttaatcactttcctctctgtttcctggggcaaacttcatcctattagaattggggggttgcttcatttgggggttggtacatttccacaaggtgaatgtcaagggcacagaatgtcatcaggttttagatgttgacaattaatgtatagtgtctcatgaatcatgtcctcagcgatctgcactcttaagttcctacgatatgaaaatgtgaactttttatgatgcatttgtagagattcattatgccacatgaagcttgaggctatttttattggtttgtgctagatgctttaacaaattaccatcaagttaatggcttcaagcaacatagatttattgtttgatggttttagaggtcagaaaatttaatgtcaaggcattggcagtgctgcactctcattggatacttgagtagaaaatcatgcccttgctttttctagcttctagaagcctcttgccttctggggcctcttccaatatgtttgaggtcagcattatagcatctgtgcatttcttttccttatctctgctttattcatgtatgctctcttagagcgaacctcttaggctctattatgttgagcctactcaaatataccagaaaaatttctacatttgcatttttttaacctaattgtgtctttaaagtccttttgctatttaaggtaacatacttagtttccatgaatagaaggtagctgttttgagaggactggggtgtgtcattcactgtaacgtgacttgattgtgtcctccccatgtgcgaaatattttcattaagtccccaagttactcaaaatctcaaatattatagcatcaattacatttcaaaatctcactctgtattgcctttaaagcctccagtctcatgtgagccctttagggataagtcaagtgaagttgttccacaccagtgagcaaggcatagtcttcgggtaaaagagacagacaatcttagttacagacatcacaattccagaagcaagggagtacaagaataaactttgccagcctcaagtgtagagcttcctctgggcaagtgttactagactctaagtcctgtgagcaaccctctggggcttgagaacctgccccttgagccacttctttttcatggctccctggccatattgttcctgttcatatgtgatcatagtttctggaggtcaaatttgggggacctaatccgcccattgatgtctaccttttaagtccaagcttttaaccatttcaagaatctttagtttaccatttgtacctgtgataattcattccgttgaacaatttcctctagaaagtctttttttcgatattcccatgtgcaggccccagtcacaatggctaaggtaaccccatgtcacacaactagggtttccacatcaccctttacttactgaatactttaaagtgtgtattcatataagggactagcaaacggccatcaggtcatacattagactgcctctcttattaaatgaagaatcttatgttttgggagtggagttgataacgtaataaccctcgaggaatgagatttattagaagaaaggcctttgtatctctgtttgtaatctcttgcatgtttttagtaactagacaggagaaatgaagccattccttcatggctttgcttagaaatatcttcagttaaatatctatgcttatcactgttctagtttcctcataattattctgttactctctaacaaacttttcttttcctctgctttacaacaccgtgcttctgaattctttctgagcccctgctaatgtcatctttgatggttatatttcttaaaagactctttatggtgatttgggtcagtcttcaagatgacaaacattgtctgcaccatgttcctggtgttttgaactatcaccattgggcttttatagacatacttaagaaacaaacacgcaaaacaaagcaaaataacccaaaaccttcaaacaaggaaatcagtgattgcaatatcacatttattcattgtgtgtcagggcatggaagctggaagtcagagggcagcatttgagagttaattctctccttctaccttctggggtctggggatggaactcaggtcatgaccttgctggcaagtagctttacctgtagacctatctcactgatacaagaaggtttattattattgattattattgctaattattattatttatgctcctcatgcttctttcattcattgtcttcctctaatcaatctgaagactacataaaagccctactttccaaagaaaggatctattagtttccagttgctgctgccataatttactactgttttaccctgtagtttaaagactacagatactattacatcacagttctgagatgagaagtcctagtatcagggtgtttgtagggctgcatttcttgaggatttttacaatgtaggctccacattttacatttattaatgtgagggactcatctgttgcctctctttgcctcacctccctccatctccagagccggcagccttgccagccccaaataacgtcctgtgaccaacgttcagaggatctcctctgctgatcttcaatcctcctgcatctattttatgaggttctggtgaccacatgccccaagatgctctaaccatccgcatagctattttcccacttcagttaatatattccctagacccttatgtgtttttgatcaaatatttcctgtgtattttcaacttgtttacgattcctgctggttctttgatcgtatgctgactccctactcagcttgtgttctgtgaatgagagtcagttgatgaaatgttggttagtgggtgacagtcagaacaaagtaaacaatgggacatttttataatcacttgatagagtggttttgtcctttaagtataaacacaaatttggccttgcattttaatttttaatactaaattactcttttcattatgtttaatggaaaggtttttgtgaggtactagaatcagtcgacctattgttcgaggtgtgtgtgtagagggctactttaggagatacctttgaaacaagagaagactggcctcacatgatcctccatgaaagcaagtatacctttttccggccttttaaatgctcccttcattatatacataccggtaatatttagcttatggactaaatgtaatgaagtattaaaacatagtacttagtattatgtaaatggtgaatgaatgtagttttctctttttcctactgttatatatatatatatatatatatatatatatattcattttcatataaaccaataatgagaagtatggcattatgtgatattgtagagaagtaaaattatgtggacttttaattgttaaaaatttcaactttgttttgctctgaacttagtccatctcaaaacatcttctgttggataaaatcagtgattcagaaaggatcatattattatagacactgtttgacattagagggatttagctctgcagctaaccacaatgtccatcaagtacctccaatgtctgcaagctttaacttgcatgctacaagtttgtaaaaatgcttccatacatgctgttgctaagctggattttttttttaatttaatagcatgtagagaaacacactaagctcatgaatgaaccctttaaattcaactgacaggattgctggttcttggggcacttaagaaagacaaaagagacataaaacattaggtgtaaattccataactgatgtttaaagaaaaatgtagaagacagagaaaaaaatgaatcacagcaccagttgtatcaagtgcatgcgtacaacttcatgaataaaatattgttcattggaaaattgaatgccctgggaacacgttttactgcctcacacttttttgagagctttgataatagctgaaacaaacaacaaaaagaagtcagtgtgctcagagtcagttccttcactttaataagaaagatgacattgagaatttgctattgacagacatttaaatattatggtaattgttgcctaatatgaattaacatgtgtatgacatatatttgtctgaaagtgttgtgatggaaagattatttatggagaaattttgcataatttttaaaaattatttatttttttttgtttgcccagacagggtttctctgtggctttggagcctgtcctggaactagctcttgtagaccaggctggtgttggactctcagaggtccacctgcctctgcctcccgagtgctgggaataaaggcatgcaccaccaacacccggctgtaattttgcataatttaaatcctgaaataattgatctagtgaacttctgtcattgtggaagaggcctgaacttgatgtaaatggaaatattgaggagtttagttgactgcattctgtgacaataagtgctattatgaatcaaaaatactttgctcagtaactttatgagaaaaatcatatgtacatgtacacacatatgtacacagggtatgcatctgtattaaagaactctcagatactttttagcaaaattatagataatatgtaacttaatgcgaaacactcatccttcccatccaagtcataaactcccattagtagctacatttactataccatggtagcattaaatgtgtttaatatttttatttgttttgctaactagtattttatctctgtatgttatgtttctgtgcgggtatacctgtgtgcagtgcctgccgaggccataagagggtgtggggtggcttgatgctggagttactggcagttgggaactgcctggtgtgggtggggacaattgaactcgggtcctttgaaagagcaacaagtgctctttcgcaccaagtttcctctccaaatctctccattacttttaagaagatttttttaaagaggcctcaagtttcccctttaaagaattagaataaaaaggatatttaaagacactaaaaaaaaaaaaaacagaatttaatgactgtgaaactagaactgcaagaatagaatacaagagtaaaataactgtgatgagtacaaattctattcttctctaatgtgccaaagaaacctcttctcaagggacagggacaatgaaaagggaggaatgaggagtggactttgggagcccatcccacacggagcctagacgcattggggtgggcctaggcactatcccaaaggatatggcagactytgaagaccgcctatggaaggcctcaccctttctggggagcagaaagtgtatggggataggtaggatgttagttggagggggggcgttgaaggggagaaggggagggaaagggaactgggattgacgtgtaaaacaatcttgtttctaattcaaattttacaaaatggagaaaaaaataaattaaaaaaaagagctgggcgttggtggcgcacacctttaatcccagcactagggaggcagaggcaggtggatctctgtgagttcgaggccagcctggtctccagagctagtgccaggatcggctccaaagctacacagagaaacctgtctcgaaaaaccaaaataaataaataaataaataaataaataaataaataaataaataaaattaagagagaggaaatcaggtgagaaggagagagatgacaggaagcccaggagaactaactccacctgtcactccccattgcagctgccagaacacctgagggaacggaacgtgtgtgttaagtaacatcacagctacccaaagatacccaagagcaggtggaatgctggcgtaaaccatataaacatgggaaatctgtttaaagataggttcctatcaaaaaaagcaccagaacagatggattcctagatgaatattagttgcactttcaatggaaaaaaatgaaagattcatttttattctagagctttatgaaccacgcctaattgcagaagtgaaagtaacattcagaaacaaagcccccctctgactcaaggcatctgtcccatcctccttcccctctataacatactgcctcttcttaacaattaacactatttaataatttatgtataatgtgaccaaaatataacaatataaaaggggtcacattgcttcctcctctgtatccttttccatttatctaaagaatgtaagtattgataagcttctttattcatgatttagtataagaatcacagattaatagatttgggtggtttctatggcaacactacaagttattagcagctgtgcatgcatttctgtcaaagaactgaatggggtatgggatggcagtaacaacatatgatgaggaaggggtctcttcaaggagttctttttgatattttttttgtatagtgtttttttcaacctgttttgaagtatttcacacatttatggttaactgagtattttcttactagattctattttcagttttggatggtgttttcttgttcataaatgctagttttctgcttttatgttgaattgaagttgtatgtgcctgaatcacataaaatcctgtaaggatttttgatacttctataacgtttcttcttaattatatgcatgtataaatataaactaatagcaggacttgaatacaagttacttggccataatttggagagttatctttattacttatattaggattttactgaatgactatgtaaaatttagtgccttacagatagtttcatctctaaatgtcaactgtcaagttgctatgttttcccaggaaatgacaaaaaaatctcaggtcctattgaagttcttgtttgaattgaggtctcagggcagattgtgagacagtcattgataggaattgaattgatgactatgtaatctagagtcagattaatttctgttaggggattgggctcaatattttaatgtgtgccaccagatgggagtgatgctctttcagtaatgtgaccagctgtgttggccctattttgaaacttgattaatacattaagccgttttaaacacacacacacacacacacacacacacacacacacacacgagagagagagagagagagagagagagagagagagagagagattttaaagtaatacactattaaagatgtaaaattatgtaaggcatgtttttctgcaaataatttttgcagaataaatacaatataaaactagtttcaacccagcattaattgcactgatggtatttttcagtgacataatcattgcacatgataaaatgtattagtgtaaccctatctaagttgtttgtttgacatacacacataccaccctgaagtacagtaggagtcctccctctccctactgttagagacagctgctttcaatcacagatatccaaagcactgtggtgtgatttcactgtgcatggcatacatataccctctgttaactggcaccatctgcccattgccttttctaggaaatccagacttaatcagtaaaccattatcatggtttgagacgacaaactaactctcttaatggtgacacaactgaattctcttatactataatatgtatttgcaataatctctggaataggtgcagtcattatattttatgttaatgaaatcatagtaaaagtctcatccctagacaaaaaaatataataactattaactggagagagagagaagatacttaaaccaaaggaaaagatgctgtcagtctgagagtgggggccatgcaaaatgaagggtttagacagaaggtaagcctggaggaggaaaaaggaatgagaaaagcagtgcaattatattttaatttaaatgtatataatttttaaaaagagatcaaaagtatcaagcaatgtgatgtgaatatacttaattaatatatcgcttcacttagtaattcctctactttaactgtgaatgtatttgtgttttgtttttccctctgcttctagaggatcagctgattcaattctgatctccctctttctctctccagctcctcaccccatatattgtaggctatgtgcttctctgtatgtgcatgcatgtgtgtttggccggatgagggtgagaggcagatgctggatgtcttccccagtctgactgactgttcagcaagctccctagagtttggctgaagacaaggtttactgtaacatgtgtgctggggattcaaacctagttcttaatgcttgtaccaccagtactttacaagctgaaccatttccctacctctctatcctgatttctcttacaagtgaagtcctcacagggcctggcccgaggtcagaactaaatgtcctgagtcatttccattagactcttgggcatgttttgaagtctctactgctctgaacttacaaggaactcccctccatgactatgcagctaattcccgaaaaagcagaaaactactcttccagatctcatgaggcttctaggcattgttacttacttaattttctgattcagtaaagtaaatattatatttgcatctggtagcaagacttgaacaatgcaagacctgagcatttagaagaagctcaatattgagctaaaatgggttgtgcggaaacagagctgaaaatactgatgtgctgaggatgtcattcacaggggaggacccacgtgcaagtggaaaggctgggggttaaaattcagagctgagagggaggaaacggagacagaagaacataccacacaataaaagcagtaccaagagtgagactgtaactctcagtgttagagctcttacgtgggaaagacagtctaccttctcttgtttgtgttaattctgataaaagcctgctgcttgctgacatgcatccatttgtaaacacattcctcagcctgcaaatgaacaagttaaattggaaaaaaaatctgtatttttattcaatggttagtgtgtatgaaatgctcagttttgcaaaatctctttcatttggtttaacaatacaatcaagctgttaaaattatttctcttcaggttttttttttaatttgactacttcagtgaatattttcaatgggaaaacagaatttaaatttataagtgaaactcctgtcaaagaagaataatgttttatgtgtttgaaatgagatcattaatgaaattttatgtgatattatccaataatttcaagggacaaattatttgaggttagcaatcaaaatgactctgcttaagatggtacagaaaccttacctgaactaggcataagaaggaagaaaagaaagaaaaggggaatgcctctggaatgcttgcattccaccagaaatacctctactggcaaaccaattaaagcatggcaggtgcctgagctaaaggtgaaagacaagtcagctggactcttttacctatttcagatctgctgctgaaactgtaacatgtacactttgctttcacacacttcaggagagaaacacagtaaaaaaccctggaaaaacaaaccacttattattctgataataaaactctcaattctagtgccactgatatcccagtttggtgggctaccctttttaaagatttatttttttatttgtgttgtatgggtttgtgtgagtgcatgcttgagtgtgtgtgtgtgtgtgtgtgtgtgtgtgtgtgtgtgtgtgtgtgtttgatacctgatccagcaaaagctataaaagtgtgtcagatctcttgaagctggtgctacaagtgcttgtaagctgtctgttacaaatgctgggaccccaactcgggtctattggaaaagtagcaaaccctttagcatccaggccattatccagaccctcttcatggggttcttatcttccccagaggctgtgtctccttcctctttgattaactttgattctctctacacattttatattctagatgtcgggtctttcatcttggaattcctttcctctttctccattttcttccctgtggattctattctccattgcagttttcattgtaacacatatgctgagagcagagttccatttcagcccacctgaaacagctcattagagaggttagctgtgccccactctttctgaaatcatcctggttttcttcaatccttatggcacaggacccattccaaatcatcccatgcctctcttttggtgtccacaactgtcatataaatcatgcagcaacagggtcttctttcctaccatcctgtctctacacgagatgcagattcagcattggcgacaatgaataactttatcatatccctaccctttttaagaagctacacttgttttaggataaagtgaaaatacagtaagtatatcctgagttgagtgcagcattcgtcacccagctcttagtaacctgactcaagcctgagggcccttctgtcaatgtcttggacagtggagacatggctccatctctatatgagaataatatcatttgcttggatcgcccttttagagcaattttgtgctctgatgtcaatgagactgagaacattcctttcccttttctcactttctgtccccctctccctcctttccctgtctcttctttcctattcactccttctgtactccattctcatctctgttcatgtcccctccttttccttcttcccttccttctcaccctcatctttgtttctgaatattgcccccatctgttcttgtcttatggactagaatatggtctctctggcttctgcactggatggacagcttcttgaggataaggatgacatcagtccaattctcacattcatttccactgccagggccatagaaagttgtgggcgattaaataaaatcctctctttaaaatatgcaatacagacatttcgttttgtcttcttcattctgccagaattagcaagcagtaaaaagtggttacatacatactgtagtgcatgtttcatgaagatactggtatttttgcttgtcatgtgatatttaaatgagtgataatggggtaacttttatctgtatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatatattggtatgggtgtgatggttttgtcctttcacaaaaaagattgatgagtcttttcagaattcctatatataatatgtatcttcattagaaattaagtttatttattactatttttaaacagaagtatgctggggctgaagaggtagcccaggtagcagttgttactcaactctttttttatttttggtttttcaagacagggtttctctaacagtcctggccattctggaactcactttgtagaccaggctggcctcaaactagaagtcacagacatctgtttgcctctactgggattaaaggtgtgcactgccactgccaatctgccctcgttgctctttagaagaccacctttagttcccagaacccacatgtgcctcccagtcatcactcacttgaattccaggagatgtaatggactcttctgacttgtgcaggcaccagacatcaatatagtacacatacatgctttcaggagaaacactcttactcataaaataaaatcagtatcttttaaaaattaaaaggaagtttcctcttccaaaataactgtttgaaggtgtgtatgggctttaaatatgatatttaaaatagtcttcattaaagcttactaaaagactatgaacttcccttttgtcaaactggtatacaaatactaattccatgcacacatattttcactgctcccacccatagtctatgtgtgtatgtgatgtacatgtttgcatcggcttgtggatgagcacgtgcctgagatatcacgttgtcctcattcactcatccaccttactaatgtggcagcctctctctgtcaatctcagagctcactgatctggctaacctttctactttggggatcacctatgtctttcacccgaggtttgtattatagccaagctaccataaacacctgacatacatgtgggttccatggatacagattccgatcctcaagcttgcagataaaggaagggcttgcccattcggcaatgccctgctccattttcacttcggagttatgtggctgggtaaccatatagagcttcccctttctacctcctggacacagcaaccgtgcttacaagtagaaattcaagacagctaaataaagttgactttccaagaaaaaaaaaaagtgtgtcccacaggattatgccacattagagacattcattcttacaatatttttattattatgccagctctaaatgagagttgattttattgataatttgtaaattttaggtatgtttacttttacatttttagcaacgctggaaaggagagccagagataccagtgttttgttttgttttgttttgttttttcccaacaccatattcttgctggagatacaactcaatggtaaaagctggttgggcatgcagatagccatatgtatgaaaacttagtaaagtaaaagtaaatcaagttcaaaggcttttctaacacatttcctaattctgtttggttttctctcttgtgacttctgccatgacttcatgtctcaatcaaaagagcttttgaggtagaactcagaggtgtctaagttcacatgcaggtagggactctgtcctggtccctgacactggctggtgcctgtgtgtcctttaggaatagccatcctcacatgccactgtctctggcattttaaagattcatttttgtttaatggtttattattttgtctgcatgtatgtatgtgtgccatgtgtgtgcctggcatctgtgtagtcctgaagagggcactagattcactgaaactgaagtttaggatggctcaaatcccatcatttggacaatgggcatcaaaccaggttctatgaaagagctgcgagtgctcataactgctaagccatctctccaacctgacatccagttatttttttgacataactttatccatgtttcctgattatcttatgattcctctgtctgatatcattccacactatgtaaatcctagtttgtgcataagtgtgcatatccatgtgtttcactatgttcatttcattgtgcaatgtgtctctagcaagagtgtggattccgttctttttgatttctaccatttagataataattcatttttaaattttttattcctatctatgaatatatgtctatatgggccaatggaagccagaagagaatgccaggcccctgtagctggatttacagatagttgtatgcttgatgtgagtcctgggaatgaactcaggttctctgggagacaatcaaggacttctaacttctgagccatctccccaaacgtacctccttctcttggcataacatgaatgaatggctttaggagtttctgctgaatggaataataagatttgggctgacacagtgagagtctacttctaagaaatgggaaatccctaggctctgttgtcagtgaggcaagactctaagctatgcagagctaacctcatagaacaagccacttgcagtgatttcatggatgatactatgtgttaaaagtgtattttaaaagagtactaagcttagaaagatgtcacctttttcggtcatttcttctgtacagtatgatcccaggacttctgataatgttgctgtgttatttcttcagctctgaatagcaaaaggaataaggtgattgggtttttaaagctttcctgcagcatgtgagttagctataaaaagaaaaaggtgtaaactacttcaatatgatgctattacaaaatatagctattatttcaaatgcacaatggtgcctgtggtaatggctgagatggtaatttcaccctaaactgtagttttcaatggcttatttaacatgaactcccaatttacactgttgactgaaacttctcaagctatattttcatgccctggggaaatttcataaagagatgaaatagaaatctctttagctgtcttattcaagcatagcaaaatataatgttcccacaactattaaaattttggaatattttggtgacatgtacattattaaatgatttccaatgctttctctttcacataggcacattttcccagaaaggacagactgtgtaatttaacacactcttcaaacatttaaaatagttaaacataaagtcttaaatatttgaacatgcaaaatgtttttctttgattcagtaggattctatcagaccactttgtttggatgctattaaaagatgcctaattttacttttctaattgctgctctgtttccacatgcagacattagagttgataattatgccagtggccccttggacatactcatttgtgttctttctatttactcttgtcaccttcagcttttcattattcacttggattctgaaactgctgagggtctggttattgttgtttctgtttgcttcctggaattgttgttgtttttgagaatatcgtaaacctttctgctgtcctgcttgaatgctttcagtcaatgacacgggaagagggaatctcatttgagaaaatgcaactgtcagttgggcccatagacaagtctatgaggcattttcttaattaatgagagatgtgggtggtaccacccatgagcaggtggtcttataaaaaaacagctgagcaagtcatgaggaacaaagcagttagcagcattcttccatggtctttgcttcagttcctgtcccaggttccttccttcagttcctgttccaacttcccttcatggtgggttgtaagttgagagaatgactctttttgttcccacatagattttactcatagtgtttatcagagcaatagaaagcaaactagaaagaaagacttaaaattgatttctctctggatgaaagctgttttttgtcctttgtctacattaaatttagaattcctacatttggaagaacaattggttctcacttaattaatcatcctataggtgttcctaaatgactagaaagtggttgcatgtagctaagacagaaagaagtaaactgctacagggcacagatgtaggtgggaagaatttgttcttgtcctggatttagagcaaaaagggatttcaaagctatctctctcttatctccggtggttttgtaaaacttgcttttttgtttttgcatattttcaggtgtgagtgttgttcgtgaatgggtatatgtgaattggagcattgtgtgtgtgtgtgtgtgtgtgtgtgtgtgtgtgtgtgtgtgtgtgtgtgtgtacattaacttgtatatattgtatgtatgtgtatgtgtgtgtatacatgcatgtatgcttgtgcatagagaccaaagcttgacatcaggagtcatctttgatcattctttcatcttgttcatggaggcacaggcagtcaaatctgcctatactacctacacaggcttgaattataaaggggagtgtgtcacactcactgtatatgcatttttgtgaattcagggagtcttaactctggtcttcttgctggcacatcaagcactttaaccactgagccatctctccagccctccctcagttcttgagtagtgatatatgttcatagtatataattgacattttaatcactttgttgactttgattatggctggattttgtgtatgcatatgcatgaagcttgaaagatgatgtcagcttcaatatagaatgttttaaccatggagaaaaacatggtaaatacatgtacggacacatgcatacataaatagctactgcctcagttagccttaactgtctatttgtaaagccttgaatcaccagcagagtcagtcaaaagtgagtaactatcttgatcaggttgtcttgtgagcaagtttgtgaaggactgcagattatcttaattgcataaggaagatccactccactgtgtactgtttcatttcttaggcaggtggtcctgggctgcatataaagccttttgagcatgagccagtgggctagacagccagcagcatttctccactgtttctgcttgagttcctgctccaacttcccttagtgatccagtgtaacctggttgtgtaagccagataagctttttcttctcagaagttgcttttggtcaactgttttgtcacagaagcaggatgaaaccagagctagaaagaaaaggcctatattctaccgtataccatggtatgacagtcaggttacatgaaggggtttttgaaagtgtgcccctaagtgatgttattccatcaagatgagcctttttttaaaatttgtattaattcaaattaggaacaagcttgcttcacatgtcaatcccttctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttattatttgaagatgaaagaacaggttaagactagaaaatttatgatagaaatacagaaatacatataaacttctcaaaacggaattgctgttcactatttctgtcatagtattctgtaacaggaaaatgaatctcacatttgtacattaatagcaagtcattttattactggctgttcatgtagaagtataatctgaatggctactatgtattgagtcatttccagaaaacacttattaactactcagttttacagaattaagcacattcatgaaaactattgagcgagagaatttaattttaaagcatgttttgtagtattttaatgaaccatacattattctgaaatactatagtctttcattccagtttgggaaatcatagagttttattccgcagtttgtttttagccaggctgacttttgaaatatggcaagatatttgaagttagtccattgggtcatttatttcaattacctgtggttttgtttgttttattttttattatttgtttgttttacttgttgttttactttttttctaatcagggtgtttttctagctctggctgtcttggaactcactcggtagacctagaactcctgtttaaaactgctgttagtgtttgtattttattacacttatattttacatgttacatttgtgtgcacgagtacatgtgtacatgtcagaggataacttgtaggagtctgttctttgcttctaccatgtggatgccaggattgaattcagggcatcacttgattctttttaggttgtgtatacttatgggcttttagtttcctcagccagttggttgatatgtcttccctttcttctgtgtaaggttttgtgtattggttgaaaatagactacaaatatctattcatttctgacttttgtctttttgtagccaattatgtatgagcacagtaaaatttcttgacaatagctgtgtgatattttgatatcagttgttgtaatgactccagttttcttttttttaatttgtatttaaattaaaaacaatcttatctttcataccaatcccagttccctctcccttccatcctcacatgcccccaccaactcctcccctccatccactccccagggagggtggggccttccatgggggatcatctaagtctgtcacatcatttggggcagagcctaggccctccccattgtatctaggcggagagagtatcactccattgggaatgagcactgtcttctttttaaaaatcaaagttatttggggagttgttttttttttctttccatatgaatttacagatttttaataaatgtctgtgaaaaataccattggtatttttattttgctttggatatatgtgatctttagtaatatgaatattttaaccatgctaattcttgcagtgcacaaacatgagctattttttcattgtgttttatcctctttagtttccctcagcattgttttattgcagtagctcaaaatcttataaagtaataagcaaattcagttaagtttcaacataaatatatagaacccagtgacatttttgtgaaccaatattgggattccaaaacagaacaaagtccattcaaaatagctaccatgctacaacactaacaaataaattcaaccacggaaatatgcccttaattcttctctttcacactcatttgtgtgagctggtgattttgtatattcagtatatctgagacccctttaatatgtctgccgaactggtaaagtcttttattttttatgcttcttatgagttcatgatggtagctatcatccttcccactttagactttggggcatccttactgacaggctttgaggctgatctggagatgaggaattatctgagtttgcttgtttttacactgtattcatttcttcttcaagtttgaaggataattattttgtaagttttgtgtgtgtgtgtgtgtgtgtgtgtgtgtgtgtgtgtgtgtgtgtgtatgtgtgtaactgtatttgtaaaagtgaatgtgagagtgggtacactcagaggccagaagagggtatcagacaccaggaatctagtgttacaggcagctgtgagctaactgatgggtactgggtccttctttaccactctagcccttgaaaggtaactttttaaatggtatgattgttactcaggaaaatgggaatcagtctacctcaagatccagcaattccactcttaggcatatacccaaaggatgcacattcatacaacaaagacatctgttcaactaagttcgtggcagcattatttataatagccagaacctggaagcaacctagatgcccctcaactgaagaatggatagagaaaatgtggtacatttacacaatggagtacaactcagcagataaaaaacaatgggatcttgaaattcgaaggtaagtggttggaactaaagaaactatcctgagtgaaataacccagacacagaaagaaaaagcatgatatgtactcacacataagtggatattagacatagagaaaaggataaccagcctacaatccacaccaccagagaagctagaaaacaaggaggaacctaagagagaccctttccctgagaaggggaaagggacaagatctcctgaggaaattaggagcatgggggagggggagggaggtaggagaaagaggaagaaagaaaggcagggtggaggagaacatgagggatctggaaggtcaagtttggaggaagaacagaggagagtaagaaaagagataacttaatacagggagccattaagggtttaaggagaaatcttgcagtagggaaatctccagggacccacaggatgaagtcaactaagaatctaagcagtagtggagaagctaccttaaatgcccgtcccctataatgagattgatgactaccttaaatgtcatcacagagccttcatctagtagctgatagaagcagaagcagagacccacagctaagcactgagccaaactcctggaatcgagttgtcaagagggaagagtgatgagcaaaggggtcaagacgatgctggggaaacccacagtatcagctgacctgagtaagtgggagctcagggaccccagtctgacagtttggaaaccattctaggatagaacttgggtcacttgggggtcctgggcagtctatggggcctctgggattggaaacagtatttatctctagtgcaggagagggcccaggttcttccccaaataatgtgacagactttgatgatccccgagggaggcctcatcctccctgaggagttgatgggggtaggacggggcgggggagatgttagtgggcatgggatgatgggagggagagggaactgggattagtacataaaataagattgtttcttatttaaataaaaatcattttaaaagtagtattttcatctttctcctgttttttttttttctgttgcattttgtatattttgtttttctttcttttttttcaataagatttcagctgaactctgctttcaagtctcaagtgacacatatttttcttgctgtttgtagaattctgttttagatctttgaaaattcaactagcatatgccttaaaggtattgtttgggtccttgcaatttctgggtctacaaacttgaatagttttcaatatttggaaacttttcagctgttaatcttttaaataatttttgggatgttcttccttctgttgcccgtctgaaattcccagtttcagatatttgcttacttaatgtcatgccacaattttactcaccttccacccctctttgtcttccccctctcctcttctctgtcctctcctttctaacttatttcaaaatagctgttttcattcttacacattctggtattgagggttcaaccatagtatttattttgttcactgatttccttagttggaggtttctgagactttaaggaaagtttctatgagccctatgagtcggttgcagacatggaattcagcacagtgcctctacatcttctgctgtgatgaatgttggaaacactgtgcatgttccattaacctgaacagcaggagtttgcagggggtctaccttaataagacagctttagcaacagttttaagcaacttgcacccagcagcagagccaaagcatattttaatttcttcagtctccaccgggatgggactgctctggttggctcagctggtttctcagctagtgtggcagcatgaatgaggtacctgttattttctgaattccttagttgggtgttgggtcactctgtggggtctgaacaagactgtgaggcacttctcaataccagagtgtgtgtgtgtgtggggggggctgggatatatcatttggctcaggcaacacacttatcagtagctgaaggctatgtggatgcctttgtaaggacttgtagattgacttgctctgagtggctgacccaccactttcctggtatatatacatgcacatatacaatataccccctccacacatgcagagatacaagtatctagctaaagactatgatttaagaaacttaaacatggtggattaactctgagttcctggatagtctttctgacctggaaaccagttctgactcttgtgttctgattgctagcacaattaggacatgaattttggtctggagatgcttcattttatgttttcatagtactttatcattcacatttcattttctactctcaaacttaatgctgtaaacagaatttctcatgttttatatcacattttaagaattgttatcaatagaatacaaagctgaaaagtcaaatacatggtggtgcagtatgctcctctgctcacacttcagagaggcaagaacttccctgttaaattcctgctgcacagtctgagattgtggtacattgtggtacagtgtgcaagtcagacagacgtcaagagatgcttgctgaaggggtcaagaccaggctggagaaacccacagaaacagctgacctgaacaagggggagctcatggacccccagactgatagctgggaagccagcttaggactgacccataccccctcaatgagaatgtcaatttacctctggtaatctatggggcctctggtagtggatcagtatttatccctagtacatgaatggactttgggagcccactaaacatagagggaaactctctcagcctagacatgcaggggagggcctatgtcctgctccaaatgatatgacagactttgaagatctcccatggaaggccttggaagcaaaaaggggatgggatagggggttggtgggggacaggagaggaggggaaggagagggaactggaattgacatgtaaaacaagcttgtttctaatttatatttttttaaaaagggaaaaaaaaacagatgcttgctggggcctgctgctggtcaagggctcattttattacacatgtattgtattaaaatgcagtagatgtgctctttcctgaggctatatagtaccagtgggtcagccctgaaaactatatacaggtaacactatatagactgaacaggctatatttttgtatttaggaatatgtttctatattcatttatgtatgtaacaataattaatgaacaaaaggccatgaatttgaaatagaacaaagaggggtgtatggaagggattggaagaagcaaaggaaagggggaatgaggtaattatattaaagtcaagaagaaaagaactaatttttaatgcagtaagtagcagacacagagtgaagtggattccttctttggtagagactgtgtataaatgcattctgtcatccagcctggtttcacagtcagcttcttatgtcttttatcccacacactccactggtagagcctgctaataaatgcttttttgccatcttggaaaagaacttttaaaataacaagaatcctgagaataaagaacacagttttgaacttattattattttgatgaagtaagaagcagggaaagaaaattctgaagaatgtaagcaaactggattatattgtaacatctacctttaaaaagatatggattctaacacctcagaacaagcaataagaaagaaatgacatcatgcttgggaaactcctgagttcgttgcatagtgagtgttgaacatattttgacactattctgaaaataaattgcacaggatttccaatataaacagagtaaaagtggactagggcaacatttcaccaaatatttgcagggttaatttctacattattgtcttctagtcactgtgggatgaaatttcatggatcatggaggccagtggattttattatccaagagaagagtgggggttggtaggcagacaagtgctggaaaaaaaaataagttcatggagaatggaagataaacacaatacagacaaattaatttacagctcataagagaaaattggatatatatatatatatatatatatatatatatataaatagctatgttctataacaaaataaaattcttgccaaaaatcaagttttacatgttggtagatatcaaggtcagtagtgttctttctatcccttgatggtgaacagacattttggcctctgcctgtagtctcaaaaggcacagccctttagcagctatccttaagggattccactatcttggtcccaagaacaggtatcgggaaatacatttctacaggaacaaaaacaaaccaaccaaccaaccaaacaacagaaaatatggcctgaattttagaagtcactaattagaggaagatttaagtttgctaatatcaccaaaagacttgatcacttaaactgctttcacagtgttttttactcatgttattgacccaaactggaatcagagatgactcttctgtctctaaaatgaccagactgggaatactttctgggttctgtgtgaaactttcacttgagacaaagcatacccacagcacatggcttcttcaagggctgactttggaataattcaagttacacagactaccatacttttaataatcttgtgcaggacagtagtcagatgtttaaaaatcccaactgagaatttttggtcatttgtttggggttatttatcttgcactagttagaatgaattcctattctatgatgtaaaataggggttgttgtcaattgggatatcaaaacagaggagtttctttacattttacttccagatgaagaaagacatgagtgattagctcagtattttcacagaagcaattgtagtaacaggtatataaacataattgggagtgactcaggctgaaagaaaactagagctctcaattttatgggttaaataattcatgtatcatattaaaaataaaaatcaacccagggcttgctctggtcaatcaagagaggacaaaatttgtatattattgcaaattaaaatgtttattctgttcagaaaagacataggtcaactctggctttgggagctatttagggattaggagctatgtcattgtcctctcgctagtaagaaagcattttggccaccaaatctgatgagctgatacccagacacacatgctaagaggaaagaaccaaccctaagttgtcctttatgctcctcaggaatgccacgggacttgtacatatgcagaaagacacacattagtaaatcagtattatttaaaaaatagagaaaaattgtgacattttctgatcactgaacatctgttatgtgtgtgtttattgtgtgtgttattgtgtgttttagagtgataagtatatcttcttttaaccaaaatactgttacattatataaagcaacatgcttccaatccatggtgcagagtgcattttgtttaacttcaaagaatgaatttgctgttgtttgcaggaagatggatgcagtagagataatcgtattaagtgaattaagacagtttgagaaagccaaagaaagatgaggcacattctctctcatttctgaatcttacattttatatagatacagaaaaccatttgtacatctttaatatgaaagtagaaacaaatattttctaggagaacaaaacagagaaaataaagggaaaactgaaaaggcaagaaaagaggatttatgggggtgaatatattcaaaatgcatagtaccactacattaacatgtccttacaaaacccagtactgtatactgtgaaagtaaaccaattaaaatattatttcaaaatattaaattaaacagtccaaactcagggaaggcaggaaatggacggctctcttgttcagcatgcagtcaatattcagtagaaattttcagaatgaatgattgttcctgattttactttgacatatatagaacataatgtcttttttattatcaaaatttaacttctatcccagtcgttgttctttgggggaaaagaaatatattacaactcaattctacttttcccttctaatgcactggagtaatgtccacattctcaggagtttatatatcaacaaacattggatgtattttcctggcttcaaagtgattttcatgtagaggcttcccaggcttcactggcctggaatgtcccagctgcaagcattgcaagtggattgctgctgagtgacctctttagttttcttttcactgtcagcatcccaggaccattgaagctcattcttcttcttaaagtcttagaaatgaaagagaagatattttaaataaatagttaaacataggtctaaatagaaaatttattaaagagattctgtaactgtgaagaatcctccgaaaacaagaatgaaatacagaaggcagctgcagtttcagtctctgtgggcatctgcggtgggtagatttgggtcgacactagaggcagcaggggcttggagaaggattggctatcactcactctagctctcacatcttacccttgtccagcatgctctggttttctgggtccaattaagagcagctgatatatgggctggagagatgactcagaggttaagagtagtgcctgctcttccagaggtcctgagttcaattcccagcaaccacatggctgttcacaatcatctataatgagatctggtgccctcttctggcctgcagggatgcatgctttccggacactgtatacatcataaataaatcttaaaaagaaaaaaaaaaaagagcagcagatatgagatctaggtttcagtaagccagggtgatatgggtggtataagtatccatagcctgtaaagtatcaccacccaggtaattagctctgagagtgattgctgcaaactagactcttcccctgtcagtgaataattcactaagaatccagctcaggcatcaccaagtggacagtataaatggacatagcagacagtatgagaggtgacccccaattttaagtttgagtacataatcaagactatgaagaaagtgagcactaaggtaaaattaatccacacacaagcacatatttgtattttaaatatgggcaaagatggagagatagatcaatgggcaagtgagctttctgtgatactgcaagcacaagcgtctgaattctagtctccagccccacactgtaaccacagtgaaattgggaccagagatgggaatcactgcagctttttaacctccagtctggtgccaggttcagtgagagactctgcctcaaggggaaaaggtggagacagagcaggtcaccctgtgtccacaggcctctacagtaatgcatggaccttcacatactccattcacactgacagatggatagacagacagcagacagacagacagacagacaccacacacacacacacacacacacacacacacacacacacacacacacacgaggacttcactaattagccctgtgatctttaagaagatctctcatgacttttgtatccttctgtagaaagcatcacgtatgtggcattgtcctaacacatctgatgaatcttcaagcttagagaaggcggggcattacaaataagcctgtctcaccttccacctcggagaagctctctttccacatactaacaatatctaattaaccactgtaacaagctgtcattaaggggtaagtggagtaaatggaagagataatactaaaattaatttttaaaagaaataatcctagtgtgttggacaagaaactcagaagtcattaaaaacatgggagtgataattaaccactaagtgctcgagacaatgagacatctatgctccaaaaagacatccacatgtgcagcgactcactgaggagcagatgaatgcaaaggtaaaattaaaaacataaaagtaaataaataaagcaaccccaaatgaccatatggcttattaatgtgctcgatgcacctcttcctactgtagtgataatggtgctggatttggggatctgggaataaaattctctttataaagccaactataaatgttagcatttgaatctaaaatgatcttaaaaaatcatgtgaaaccatgtctccatcccccatgttgcagtttgcagaggtggggctttgtggtggtgatatgataaaggcttcaaacttttgattggtttaatctctctacggacttatagtttgatagggatggtattccttatgcaaggggatctctctgcacttcctggaatattctatgtcaccacaggcctacaaacaatgaagtcaactgaccttggactgaagcttctgcatcagagagcagaaaaacaaccctgtccttatttcagtttacttctctaggtcttttgtcacagaagtggagaacaaacaaacagaaatagagctttgtctccagaaaccattgcactgtgcagtaactgcatgcaaagcaacagctcttggttggctggattcccacttattaagcatccatttatcacactctagtgtagacaccctcagtcgccttgctgtttccccttacagcccaaatgataggatgtatccctgttctcccagagccctcaccttccctatttctgcttcctgcaggctatggattcatctttgagggaggcactgaattctctgagagttgcttgcttgagtctttcaagacacaagtgtgaccaccttcttcctggcttagtgttgtctgagctaccccaggaaacacaatttctctagggtctttgggttttcttgaaaatatccactggtctctcttcacaatctttgaaaggtcttgtgcaacgagaactgatagctcttgtactctttagactgtgaagcacaccccacagtgttttctgctttatttctactgttgagattttgttctgttttgtcctcttcttttgttcagttttatttatagagagaatgagaggtagagatagggattcatagtatcctataacttacgtggcttactttgcagataattaaggaatggcaatgcagacatataaactaaataatttgggaaatgatgttttgaattataaaacattgttttttgcctttggagtatctgtcgtaatttactttgagcactgtgtttccctggtgtcttaaaatatagtataacctcttttaaaagattggttttacacctagaaaataatgaattggaagaatataacaaaagtgtttgttttcggatgagcacacagtctctaggccatagctggcgaagagaggatgctggtgttgtatgttaatgaaacccccaactgatgtgtcagctgaccttcatccctaatgtttagggtccttcacctctttataatgtccccaagagctttccttccttccaccagtgtcagtgagtcatgatccctgctctagggccttcctctgcctcagtatgcagctgtcacccctttactcagttctaatgtctgtggtcgctgagctatcttcgttggcagttttatttctgctgctggtagcaaatagtgcctaaacttcagagtggatacatgctggctctcccaaaatttaaactcctcccatgtccccaaaactctccatctaaatcaatgtataattgtccagccagtttgttcagttgtatgaaagaaccagcagtaggcaggaagggagagagcatgctgagtcctcattctgggaaagatccatcagatgaccatataacagctgtccgtctcttctcccagccaggattcatctcataaaacatcttcagaccttccatccctggtgtcacatccaagttaattctggaaattggggtgatttctacactaactgctaaaacttggaagtttctccaccatctcaggaccctgcaatattttacaaccaatttggggatggcaataaccagtaagaacagaagagaacatgatgttaaaatgcagttgtcctttggaaactttggttttgctcttcgttgtagagagaccatttattaacatttggcaggcacttttagtgtggaagtttcctggttttgttgttggattaaactagccagcacaagagggaaacagaaaatctcagggatttagagatttatctctcttaggatggctcttcttcatgaatatttataatttagatcctctaaattcctttacactgaagaggctggcttttctggtgatatttttagtttgaggccaatcaacatagtcagttgctggtgtgggtgttcctgctccaccattggcctccaatgaagagatggggcagtcctctcgatggtacatttctagcacattttggctcccacatggaaaagagattacagaaggaaggaaaatcactagggctcatgaggtagctcaatagttaacagcatggactgattttgcagaggaccagtgtttgttttctggcacatatgtcagatagtttcctgattagtgtttttattgttgtgatgaaacactatgaccaaaagcaactgagggaagaaagggtttattttgtgtgtgcttccatggcactggtattcatctaaggaagttagtttaggaacctggaagcaaaaattgttgcagaagccatgaagaagtgcttactagcttgctcctcatggctttcccagcctgccttcttatagaacccaggttcatcatcccagggtggcaacagccacaatggcctgggccctcccttgtcattcactataggcttacctacatcctggatcctatggaggtgcatagttctccaatgtggctccctcttttcacataactaacttgtgtcaagctgacataaaagctagccagtacagttcccaaatacctgtaactccagctatatagaatctcacatacttctgaactcctcagacacctgaagtcacattaattagcacatacccacaaagacaataatattcatgttatacatatatgtgtgtgtgtgtgtgtgtgtgtgtgtgtgtgtgacttaaaatttgcacccacatacacacacagacagacaaagacatagcatgtataaataaagtgaatacaattccttgaatgtattgtcattttattgggattcttacctttttagaaatgggcctttctctccacacccttgtgagtctgaaggagtaggaagaacattgggcatttctgaggccacagagaaggagccatctaacatgccttactgcctcagaagagttccagggaagttgataaaaggacattgctggggacaagctctcctgagtaaattgggagcatggggagagggtggagggaggtaaaaagagaggagaggagaaggggagtggggaacatgagagatcaggaaggtcaagttgggggaagaacacagaggagagcaagaaaagagatatcttgatacagggagtcattatgggcttaatgagaaacccagcactagggaaattcccaggaatccacatggatgaccccaactaagaatctaaacaatattgaagaggccagattaaataatcttcccttattgatgactaccttaaatgccatcctagagccttcatccagtagctgaaggaagcagaagcagagattcacagctaaacactgagctgaactcctgcgatccagttgtagagaaggaggagtgatgagcaaaggggccacgaccatgctgaggaaacccacagaaacagctgacctgagcaagtgggagctcaaggactccagactgacagctggggaaccagcataggacaaaaacagccccccctgaacgtgggtgacagttgggggcttgggaagtctatggggcctctgtcaggggaactagtatctatccctagtgcacaaatgggctttgagtgtccattggagggatactctctcagcctagatacatggggagggcctaggtcctgccccaagtgatgtgacagaccttaatgatcccctaagggaggcctcaccctccctgaggagtggatagtggtgggagcagggaagggaagaagggaggcagagggaactgggattggtatgtaaaataagatttttttaatttaaataacaaaaaagacattgctgaaagtttcccctacaaatgtttttgaaatgtggagacactcttttcttcctcttcctcctcttcctcttccttccccacctagtatatattagttacttttatgattgttattgcaaaactccctggcaggagcaacttaagaaagggagactctcttttggttcaccccttgaaagattcagtctgtcgtaataaggaaggcatggggacaacagcatgagctttcattcacaatggaaaagcagatggctttcttttgatgcagcgtgggatctacatctgtggagtggtgctacccacagccagagtgagcctttccaccttaactgaaatcccctcactgacaaaccctgaggtttgacttgaagttgattctccatcctgtcaagctgacagcattagcctacctacccaggatcaccatgatactctgaaatgagataaactggtatgtaatcagggtttgcaaatgtggtgcactcaattcccttctgaatagctggcctagggcatgtctgagacctcaggttctggaagaacacaacagaagcctggggaattaaattgttctttaaaacaaggtttacttccccagcatctttcacctcaaatactttttattatttttttagagattattgtttgctctctctaagattcaaagtatagtccttgagggcatgccattctgagaacttccaagctttgacgttgctgttgccttccttccttttattagtgggaatgctggatctcatcagcagagcaattgtatacactgttttgggcatgatagggatatatgccttttctgagctctgatttctgtgtcttttccaggaccctgatggcacccacagtgctgacaccttgggttttgtaaaagtcaaatgagataaacacaaagaacaaggtctttaaatgaatgtctatgaataatctgaattcattattcgcaaaacaaagagcttcacacacaaaattctttgcctcaaggctggcaggatggctcagccacggaaggtgctgtaacaaagcctgatgacctgcatttaatctctgggagaaaactgactcccactgattgtcctctgacccccatatttgcatctctactaactaaataaatgtaaaaattctttgcctcaaacttttatttcttgtgaaagcctccccagatgtaattgttattcttttgctagaaatttgagagatggacatggaccatagagagaacattaaccagtttattataggcagaagagcaagagggggctgtagggggcagtaagccacgcctgttagaggctggctacaggtgtgcctgaccaggcctgtcaaggtgtggtcaaggtgaagtcaggatgatgtggcatgggctcttaaggggcctcagagggtatgtaagccccttctcctctccttctccctggcctcgctgctaggctgcccctggcacgctctggcttgcttttggctggtatttatcagaataaaggtatcttgaacctacaagctctcccatgaggggggagagagagaannnnnnnnnnnnnnnnnnnnnnnnnnnnnnnnnnnnnnnnnnnnnnnnnnnnnnnnnncgaccaccagagagagagagaggataataatgctggggggttaaaagggggagctcatgcatgcagccccgtaatgagtgatgtatccatgaaatgaccacacagcacagtgccctttaagctgcctaggtcctgcctgaacctttcagtaatcaaactgtaatctttgttttctcactgaacttgttattatatattatggagtgtatgcaaataagcagacttactatgtgcaggtaacctgtcatgcagaatggaaaaaaatgaatttcttcagaggataagaaaatggatactctgtggaatctcattgtaccataggataattgtttatttagacagttgtatcatatatctgtatgaagctgacctgttctagtggcctattctggggtttcatttgctaataatgcaaataaaaaggcaatcaccattatgccctaaaagactaagttgaagtgaaggagagtgtttgtttaaggggtgaattttgctcaattcttatctacttgctgtttgtcttatgaaataagtttttgttttttaatgataatcttttcaggctgaatatttatagctaagactttgtatggaaactctgaacctaaatttgtttgtatcttgttacattctttggcaagactgaagacataaagcctgagcaaaagacagtaagactttatcatttcaaaactgcccacaaacctcataacataaataaaacatataaaaatgttccaagtatctggatttacaaatgagtcacaaagtacaagggagaaaaatccctgtatagatagattcatatgcaaatcctcctcataccattctattagaaatgcattgaatgatttttacaattgattacaaaccctttgcttctgggtttgggtttttctttgatataagaaagaacagataggaaaatgtattttgtgagttttgatttctgatttgcatctttgtaaattctcctcactgcttctggatgtttctaagcctgaaggaaaaatatgcctgtgtttgacagaaaaaaaaaaaaagtcttttcagcaaacatgaaagtattatattacttgttttaactctcacatacttgttagaagatattatggaaatcatcttgaagagcataaagagcgtgcattgatgtgtaaacatcacactgaagtctctgaaagttggtgacatttgaaatgaccttgtaggctatttgctagttagagattgtgttgttatttcactacattttggtagacaattcagccttgaaatccaataccctttatgcagttcgaccctaaagcacatgtcttatccatctagggaacagccccatcatcccactctaggtactttgctcctggtggtctcttggtccacatggagaaactataattccaagggatttatttatcttcttagatccttgttaaaatagtatggaatattgttgtttttcattatagtgttatgacttcaatctgtagaaattgtagctacacattttgccctgcctcgctttctgcacagcaattagtctttgagatacaacatacgataatttgagggtgtagtataacttaaaagtacatgatactatccacttttacttagaagtggttgtttgtattaagtatagctattccccagagatccttcggcaactggtatatgagcagttttcttcctaaggcgtacaaaagaaaaaaaatcactagtacatattagctacaaaatacttgatcccaaattgctaaatgtctctatttcccagagaccccccttttgccatctcagtttccctcttgtcaatttccatctaatggctaacattacacacaggctacagaggggttgaattacatatagctttcagagattctcactagatctagtgtttagaaaatcaagatgactaaacagacccctgcaaaggaagaaagccacttagatggagttgggggtgaaagaagcaggcttggtaattagaaagcactttgatgtttttcagctgtcactcaatggcccatttccacttggtagaaaacagaaagtggccataagaataaaacctgctgcccctgtgggagtgttacctctcaaagcctcatggcccaggctaatctttcctccataccactcaaggagcaggaagaatctgaaagccttggtcagcaatccagacaggattgaaaactgagcaggatggagtggggacttggagtcaggttgaagagaggattagtgtactgactgaatctggaactgagcacttcaagttaggactactttgaaatagtgaagtaacaatattttcttccttccttccttccttccttccttccttccttccttccttccttccttccttccttccttccttcctttctttttgagacaggctttctctgtgttgacaaccgggtgtcccgggaatcactctgtaaaccaagctggcttcaaactcacagaaatccgcctgcctctgcctccccagtgctgggattgaaggagtgtgccaccaatgcccggctgtaacaacatcttgatggaccatccttggttgtatgtaaacaagataaaagctcatgaaccattagttatgtgtatttcatgcagtatcagttcccttgctttcttctctccccctctggttctctggttttctttcttctctccccctctggttctctggttttctttcttctctccccctctggttccttctgccctccattctttgtttcttttctcccctattcttgccacccctctgtcttgtttgtttgtttgtacaggacaaggtatcatctccatgtaactcaaactagccttggactggatatatactctagaatatcctagtactaactacataaaccccaagactggctttgtgtatgatgaatcagaggcaggcatcaccatgtccagcttctatgccatctttataatatttttcccttctgccatattcttttcttgaataaattatatgatataatgttcaaaataatgtctcatttcaattcattacatgtatagtgcatcctgctaacagttcaggacttgtaacttgaaagaaaaatgagtttattttcattatgattatatatagtcatgaatgataataatgcatgcctaccctgacagtagtgatctagtatattgctttcatacagatttgaggagattgtgaatggtattttgttttcctagtttccttcctccctccctcacttcctccctctttcctttcctccttattccttctttccttcctcctcccctccctcccttccccctccttctttccttcctttctttttgtatacaggaatgctactgattttttttatgtattaactttctatacttctgctttcctgaagatgtttatcagatgtgggagttttctcatggactcttagagtcctttatgtattaaatcgtttcatcttcacatgaagatacttggattcagtcttttcctgtttgtatcctctttatctccttcacttgtctattgctttagctaagacattaaggactctattgaacagagtagggagtgtggacatcattgttttcttcctgattttattgaagatattttgaacaataatacagctgaggactaatggaagttgtgacatgacatgaaatcttttatttgagtctctcatgtttatttatgaagcaaaagttgttagtctgtttactatactatattggattatttgagaagcaaagtgaaaaaataatattgatgatgactctggcagataaaataacttttagataaacttcatgagggaatattaccaacattttattggtccattcttctctttctttatgttattagaaaaacagcgtttgttgcagatagctctaaattctttgcttctctctcccctctgagatgaccttttactttaccatttgagcacagtttcccctgagcaaggggggatgaattcagtgatgactgaaggagaatgagcatgatttccctaaagcacatcactttcctctgtttcctacatattttcagcctgagagtgatatgtttcccaggctgtggccaatgggatgcttaactccctaacttatatatcaacttatatgccattaaaataagaataatctgtctgaccttatgatataagagccaaatgaaagttataaacacaatattcttgaagactggcatctcagtttggctggagtgctttcacatcgagatctgtttatgcggactgactcacatgagatatggtcatttgcttctccttgatgttcctagacctgcggctctcaaccttcctaattctgcagtcctttaatacaattcctcatgttgtggtgacccacaaacataaaattcttgcactgctatttcataactgattttgcagctgttatgaatcattagtaaatatctggaaagtgcagagtactgaacccagcagggagagagcagaatgctgagcacactgggaatgctctgaataccgatcactgcacaaaccccacaggtaagtcaccaaaagtaaaagttgttgtcaagcatatatcaagccgcatgaaattggaagtggctcatgctgatggttaagacttaaagacagagagatgcctggtgttttctttaagtgtttgttatattcctatactttatagcatgttgtccttaacttgaatcatattcctgtgtattttcttaatttcacagctccacaaaagaacaaatactgatatgattaacatctagataagacacgtctaatagacgcttaaaatgacataggaacataccatgagtagcattacactaataaatgggaagaatgaaatggttatacccaatagatatgtccctgttgtcttgagcagcttgtgttgttccttagtcaagcaatataaaaccaaatcatagtgaaacatgccttcaatgagagaaatcaatgtaacccaccctaaggacagcatgtcagtatgatccttgtcttttctgttcacaggcagacttatgttggaataaggaagttcctttgtgaacctgcaattaagagtgttaagtgaataatgctcctggctcacttaggctatcagtggtagtttgctctactaaagttgagattttcaaaatcaaactcgcaaaagtattgttcatgtctcatttcttcatggggcattaggctctaaagcttataagtatgcaaaacagagtttgggttacaatgaacatacaactacagtattgaacagaatcaagaaactagaaaatgtaagttgatgctactgtatttgcatcctgagataacttgtcttcctagaatttagttttatatgcactgctcaaagggcatagactgacattcctgggagctaagtcttcttttttctattttccttgcaacccttttattgttcactgcttcttatgaacaacatgtaaatctaggctggtcttgcagtgtctgtggctaagcagaagagccctgggtagatggaatagctcttactgaaaataattggaatagattatgggatgtggaaacactctaggagtgtattgtgatctagaaaataaaaaaaaaaaatcctcaaatgctaaattgaagggaaacagtcagcctctgtttagatgccacaacctgtctcttcctttagggttcatggcaaacactagtgtatcgtttattgaagaatgtagaacccatactggaactgacttaaaatctaggctatgctttcaaagaagaagtaaatagaaaactactgtaagagtgaattagtcactaagagcaaataaaaatgtctatcatcaggaagtgagaacatcttaactttgacagttttaaagcaaatggagaaaataaagcaaaataaaacaaaatagagggtttccatacaatttttgagttagtactgcatagcctgacaggtaaagtccatgctagctctatgaaccaattccaaatggaaaacatatatatatatattcgagacaggatttctcggtatggctttggagcctctcctggcactcccttgtagagcaggctggcctcaaagtcacagagacccacctgcctttgcctcctgagtgctggtattaaaggcttggccaccacctggcagaaaacataatttttatcaacccaggttgatactgaagtactcattagtagaaaagaattttgtggcagtacgaagcttcatataaggtcttaaataatttctacaggcatatttaagacatgcatgcataaggcaaaaagaatcaataactaccacaagtgtgcactgtaaaagagacaaacacatgggagaatcacaccaatgaaaactgcagatattggtgttatcagacataaaaataaaataataattctggtgctatgttttagaattatgagaagccataaaatgttagcaataaaaagatattaaaaacaaaacataagtaaaattaaaccaaataaatcttagaaattaagtacatatattatgtgcatatataaatcactacatatctacagtgaattaaattaaaaatttaaacaggatgaggtaaatctgcttccaaatgggagaaataaattgtgtcggatgaattttctcaatcaagagtaactaaaatattaatgaaaaagccttagaatatcctcccccaagaaaacattggaagtgcacaaaatctttaaagtactggattcagaaaaatgcaacaatccgagttagacatttccaaattagagcgatcaacttggcaatgtgaaactgaaaagagtcttgggcagcttccttgatctaggagaataaactgaagttcttgagcaaactgcctagtaaacacaagttaaccacagaaacatagaaaaactccaaacgccatgttgtggaataactgagtttgtaacagattctgagatctgtggattcagtgaggttacagcacactttgcttttacagcacacacgtgagctttgaggtctctgctagaagaattcccctaagcctgatgatctgataaaggactcctcacattattctctggcttttatatgcatgtggctaaatgttcacacagacgcatgcacatacacacactttaaataaaatgtttataaaataaagaaatttatggtgttttagtttgtttgtttgtttgttttggtctattttcagaaatctcatgtttggatttatataaccaccaggaggcatgggcagaattacaaaaaaaaatggacataggttgttaaagtcatgtttggattctggaatggctaaaacgtagggccagactccacagaaactgaaatcccaaatcatacttcccagccttttaatataattgatgaagatagtatatccatactatgttattctgtttataaaacacacatttccttgaagaaaatcttatgtgtactatgtactcagaagtcaatatattgtatatgatacagaatcaaatctaataaacattgcaaaaacattggcttaagtaaatataacaacaacaaaacataatccttcaaaggtataaacattgaaattgtcagataggaccagcaagaaactataaattaacacaataatgccttggtatatttatatatgccacagaaatcaaataacaagatggtaaatttaaaaaaaatgaaatttcatatatgagtactgaatttataacaagtcatatgtcttctacactcaaattattgcctcatattctgtaattattactattatttattaagacaatctgttgaatcaatttcatgctggtcttatgtatgtttttaggactgacctcgttatatattataacctgttgcaggtcttgtacctagagaagactgattctccctctcttggtattcagttgatctccatctgacttagctaatcgtatctcaggtcaggctttgatatttcccccaatgaagtgtgcatgtaaacctgtgtgattattattcaggttttgtttagatgactattttttgagatttcataggagcacctttttagttttatgtaaaagacactatctcaccacagacatcctgtggattttacagtttttctacccctcttccaagatgttttctgagccttaattttagccaaaggcaggaaaatgtaataaaaatgttcaggaggactgaaggtggagatccatgatagagtatatggtttcttgcactttaaccccagtgtggaaaaagaacaataacaataaattaaaaaatacatattttagaattgaacattataaaataattcatatgaattgtttggacagcagatcagtgtggtaatatattatttatgatttattaaagcatacatgaatattgagaaagcaaagccagcctcaggctcatagagatcaggcagtggtgatacatacctttaattccaggactcaggagaaaggcagatggatatctgagtccaagaccaacctgggatactggagagtgaactcacacctttaatcccaggatttgagaggtataaaatgtagagccatttggtctgagagttagtttctagccacattgaggagagcatagcagtgtgagtgaatctgaggagcagtgaagttgggagcagtttcaggattgcccccttggtccaggctgaggtaaagataagagctagtggctggctgctttgcttttctgatcttcagcctgaagctttaaacccaatatcagtctttgggtcttttatatattgtgctgtatatcataccaatctagataaagggaagctaattctgcatcaatatagagagaaaaacacagacaaaaatctgaaactatggtaaaagtatcgacatgggccatcacttataacatttagcatatttattcttagagttcctgaaaatgaaaagagaaatatattaggatagtcaatacttaaattgcttaaatctgcaaaatttgaggaatgatactaagtacaaattcaagagtgctggaccctacaaaatagttgcacataggtatttcaaaataaaacatagaagatcacaggtttaaaaaagcacaaagcttgagatcacaatccaatatctaaagatgtttatttattgacttacataatacgttctccaatagtcaaggctggctttgaattaactgtgttgccaaggataacattagatttctgattctgcatcttaggatgacactgaataatctctgctccttcatcttagggtaacattgaaattctgctccttcattctgtggtagcaatgaacttctggtcctcatgccttcatatctggagtactaggatcactggtgggcaacactgtatccatattttaccatactaaatatggaaccaagtaatatcttgcatgctacaccaattcttcaacaattatgtgaaagtccaaacccaaagcattatgtagttgttgatgttttcctttttattactgggcataaaacctggaatctcttgcatacaagggatatgcactctaacaactaaactcttggtgtgtgtgtgtgtgtgtgtgtgtgtgtgtgtgtgtgtgtgtgtgtgtgtgtgtgtgatttttttagagagaaagaaaaaaacatgaagttatgtgtgtagagtggtggtaggatttgggaaagagaaagaatacatatattttattcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttccccgagacagggtttctctgtgtagctttggagcctctcctggcacttgctctggagaccaggctggcctggaactcacagagatccgcctacctctgcctctcaagtgctgggattaaaggcatgtgccaccaatgcccggtgcaatccagttttaatatgaaattttcataatgaaaaagtgaaattcaaaatgtgaagatagtgctttctgtacataatggggaattatgaaatgagagaagctagaacaatgcattaattatttttgtagttgttgggagaaattatattgtgatcttttataacattttataagtcttcaacattatataagaacttgacagtagatgttcatgtttctacctgtaaatttccacagcttttgctgtcttggtgttatcattgatcaattggtgtttttgttacctacctaatgatttttcatattatattgcaaagttgttaaattcatagttttgtactcataagaatgattcagaagagaaaaaaaaaactatttcatgattctgagtttgagcagtaagtgaaactaagtctttggatgaccaagattgaatggaatcatgagagaaagcaaagttgtctcccagctgtatgtaggaacttggattgtctcccaggaaagcagttatgcaggggacagtaaaatgttaggctgatgcacaagaataggcagtagtgacctgggattcgtaagagttttcatcacttctattttctccagaaattaaacaaactctaaagagatagccagtaaaaagtgaatttggcaatactagaatcggtttgaagattgacgaagatatgggatactgagaataggataataatttatatttaaagacttcctgatgtttgcagttatgaatgttttcagacagtctgggaagtttgggagaaaaagaatgatatcataacttcagacactgcaactcagagtttgtgcacacacatataaatggattaataataatcaatttgggggaattttgcttaaagacataggtaagcacttctgccaacctagacaacctcacagccataaactcactttcttgcattgctgtctgattgtctcatctaagttaggaatattaaatgaaaatgatatcaatttttagaaagacacgaaatgcccatcatctaggaaatcccatttatagtatttatttaagctaaataaagttcaaaaactcaaaaaaaaatcatttgtaatgtccaacaaagaaaacacagagtgggaaagggaacattcatccatgtggttctctgaccttgcttgtctgggaggcattttgattatcatcatgttacctccattggtcttcagaaatgttaaacgaaacactgttttagaagaaattggttttatctgaggcagaataaggaatattaggctctcttcttgaacagctatttgaaattcatggaatagcccacaaaaccttttatttatgtctcagtttttttcactttcattggaaaaagatttcatatgtgaacagggaatgtcgggaagtatgagctactcagccatcgtgtgtgtgtgtgtgtgtgtgtgtgtgtgtgtgtgtgtgtgtgtgtgtgtgtgtgttgtgtgtgtgtgtgtgtgtatcattctgtgtgtgtgctcatgagtatgcgcatgtatgtgactatgtgtgtgtatgagtatggtgtgtgtgtgtgtgtatctttgtatatagaaacaccgatgttgatgattctgcaatgttatattggctgataaaatcttcattattagtatatttggaatgttgcttaaattatgctgagtctaaattatctttacctagttttaatattgagtcattcattgtcagtttctgtatcatatctaactttgtgtttaccatcagagaagacctttgtaaattatccatagaccacacctgaggcaaatatttctcatttaccagatatagccttatattgctttggaaaatgtctcaatttgtagttgtttttggttctgtgactgtagaatattcctagagccactctccatttggaatataccattgtgggcaaattagacacatgttcctaggcatagctcctgtacttgaatcaatgttagttgtctcttagtctctttgaggtacagtgtatgttttgcatgcccaaattaacaaatcatcaggctgaaaacttattttgtactcttttgtcagggtgatgaactacttgagtggtatatgctaatgacgacttttcaggaagattctctgtttctcttctgtatagatttagatgttattgttccaaattctatcatgtgcccacgggggggggggaagtaatagaaagcagagaccaaatgattttcactgcagtttcttctagctataagaactgagttaacaatagaaagtgcttgtttgaatcctgtagttgttcacaacaaactcaaggaagaaaaacccaagtcacctgttgttagaggaacacaaccgactttacagacatatatgaagcagcatcatttagcagaatctctagggccttatttagctcagtcttacttattttagtaatcttggcaaagaaaagttggtctttttacattgtttttttaaaatcacaactgaaatagtgtcaagcacactttgaattttaacaaattctatattctattatattttgaaggtcatggattcatttgcattcatagacaagtacttcagcttaggacagagttttttatcttgaatatactttatgtattcagcaccccactgtgccatttaaaataatcctagaatcaaatgtgaatcattgccatgttctgtcaaaagtcatgtgctctataccttcatgttggcccatcagtagattatttcagctaaataaaaataggcagtatgcaatgaagctcagatttccttacagtaagacactttaaagatcctaattactacctcataagtaatttcattttgaagaatatggatttcaaaattataggcacagagatctgagattgttgattacaaacccatatttttataaatgaggaaatttgtgagtcagggtgaattggattgcccaagtttatgtgcccaataagttaagcggttagcatttctagattgtgggatatatactgagaatgcattacaatgattaccagttagcaaatatcatgggaaatctaatcttaaaaatccagaatcactcaaatggtagagtaagtgtgaaaatctttctcccacagtcttgaaatgcctgtccctgctagactttgtacagacggtctccagcttgtcgttgctgcttaaaagcccctgtaaatgaatctgtggtgcagctccatttcctgtgtattatcctcctacgtgttcctcctgaagctgcctgcagttctgacaccctgtcaacacaacccatcaagctctgtgtcttgcagttttctagctatggagctgataacttgcaactagaaattatgtatctgagttgtctttccaaatgtgttgcaaaggaaacccaggtaatcgttaaatgcttgattgaagttttcctcacattgctattatccgtcactgcatttatagtttcccagatgtcacttgggccagacatgacgtcattggcaagtatttctccaattcctcaagtgtatttgaaactttgtcaatactaaaccattgctatggttcctgaaataggttctttcattcctctatgacataactattgaagaattaattccttctgtactgttatataaatttacaaactgacaacacatatttttagaattcaacagctaactttcttcagaactttagtgtaccttagtagttgaaacaggtaaaaataatagagaagtgcactgtagagatttgtaaacagggttaaccacaaatttggtctactctccatagtaaacactgtattaattgaaatggtacaactgtgtgaacaaatattgccgagaatttgcccttccctgtgaattttcttagaagatgttatggtttttactgaattataatcatgtgtgtgcatttgtgtgtgtgtttataagactcaagtgatcacattttagactttaagtactatgttgcttatggaagatgtatttgggtaactttccgttttatatatggctcatagattatacatttgtttcatgcctctggtcaaaggccttagggtggtttgagtgagaagcctcccatagacagacctgagtatttcaacacttgatgctgatgtcactatttgaggaagtttaggactttctggagaaaccattgcactgtagtcaggcattgagagtttaaagcctcttgccacttccagttcaccctctgtttggagcttgtggttaaaagatgtgagctcacagcttcctaatcatgctgccatgatagattcttacccttctggaactgggagcccaaggcttggtcatggcagtttgccaggacagaaaagtaactaatatagaccttgacaacttggaattgttgacatcttcttaggatgtagcaattggctccaaaatctgtaactctctctagttccacatttaaacactaaattggaagtgaacagtaatggggctggactgtaaaggaaaggaattgaacttggctcactacactctttcattatttgccatccttagagttgtgcttgtttttaaaacttcaaatgacaggtgtgttgcaggatgcactttcattgagtaaaaaaaattactttataataaccatgctacaaaattattacttggctcaggggtgtgactgtcatttaggcaatacttggaagcagttcttcctagaatactagtgaaacaatgtttacatatttttctcttttagaatggttgcagaaaccagagagttgaataccaaatttttttttttttttgtgtgtgtgtgtgtgtgtgtgtgtgtgtgtgtggtgttgaggtaactgaagtttgtcctatactttggccctgataaacatgattcccatattggagtcaggaagctaaggtcagccatactcagtgacgttcctgatgatgtgtgctatggcagtgcagtggtgaaaggcagttgacaactgggctgtccaatttgctgaatttatcaacagccaataaaaagcctctaattctatttctgtcttgctatgtatctaaactcagcagtaaataggaacttttttaactacatattttcttcacttactggaagactaggattttccatagcaactcaaattttgtgtgagaacatatactaatcatatgtgttagaacattggtgacaaagtagttctaatgccttgcttactaaaattacatacagtgataaaacaaattatgaatgaaaataaaaaatatatactcaggaatgctagtgaagagaaatagagctcactgttgactttcactagtaactggaagctatttcacttttctgcttctgttcttaatggataagaatgataaaaacacgtaaaaggaatgaagtatacacatagacaatttgataattatggtagtatgtggtagaagtttaatagatattaacttgcagccatgaacatcaaacctattttctttaaggataaaatatttgtataaagatttgttcttacagcatatgtattagaaagtgggtgtttccatactgaatcaagttagacactaataagattgctcagcaatgaaagcacttgttgcagaactgctgatctgagtttgatccttcaagcccgagtgttagaagtggagcaatgaaaacaatttatcctgatgtccacatactttttgtggtataagaatactctgatttgcatagttatatatgtatgcacacagaatagtaaaatgtaatataaatataagctagaaagtatcttttaaaaattttgttcatcaaccctttttatatttgtaatattaaaacatgccctggtggttaatattttatcaggaatggatgacacttgttttatctttttaaattgactaaaacaatatgaaccataagagaaagaacaggaaatattccccagtgatgcaatagttatttatacatatatttttttattcattaagtatataggaacacctatgtatatatacgaatatatatgagatgacatgaaattacacaagcacatacaattatacaagtacacacatatatgtacatatacccatcatatatataaaatcacaggacatacgaggaagagagtgatattgcacatattttggaagatggtaggttttttggttgcattgtatgatagaagcctttgctgaggacctgggcatattacattattcaaatgtaatcagtcaccaatttatatccatttgcaatggtagcaattacctaatcttgcttgtaagaatttcagagtgtctggttatgaatgtaacatttacatgcaataattatcatagtgttttaggtaatgcatgcctcaccatgaaagaaatttatttaaatgttttagcaataggaatctcatttttctttcctctggtctaatgaaccatagggtttgcttcatagcatttttaatgtgagactattctattcattcaagaagaaagacagtttgggcagataataatagtattacagaacgagatggttttcacagtattcagccatattgatctgtccatttctattgccttttctgatacccacaatggatattttccttcctgggaccagtgatactataaaaataggctttctatctgtcttttacaaaatgggtagaaacatagagggattgaattatcacaaaaaatagtgcaaatgtggaaggctgtgagtcaccatgttagaacataaggatgcaagtggtccctaatccttcctgagtgattgccttgctgatttcagctgtccagaacattgaaggactagagcaggggaatcagctctcatatgagggaagcagcatacctctggctttctttggtaagactttctttctgaatgatcagccaccttgggcattcagaagccacatgaggaggctgaagcacacagcttctgcaagtgtatcatcaccatgaaattgtagagctgtgaactctgtggataaatctattttctttccctggtgcctcatttcctaactacactggcacttccctggcagattgtcttattcagggtatcaattgctatgaagagtcaccatgttttgtttgtttgtttgtttttctctgtggcttttggaggctgtcctggaaccaactcttgtagaccaggctggtctcaaactcacagagatctgcctgcctctgcctccctagtgctgggattaaagacgtgtgccaccaccacttggtaactgtggcaactcttgttttaaaattaaatgtattcatttattttacatcctaaaaacagttgcccctccttcctctcatcccattcccttttctcacctcctctctgttccctccaccagccaatccactcctgctctgtttctcttcagaaaggaaaggccttccatggtgtcaacaaagcatgacatacatatcaagttgaagtaggattaattcctctttctgtattaatgttggaacaggcaacccagtatggagaataggttcccaaaggctacctcaagccttatggacaggccctgactcattgctaggaggcccacaaatagaccaagctacacaactgtcacacacatgcagagggcctaggttggtcccatgcaggcttcctacctctctgttcagagtgtgagctgctacgagcccagggttggtttgtgatgaccatgacctccccttgcatctatgatccttcctttgtctcttcaacagaattccctgagcttggcttagtacttgtctgtgaatctctgcatctgcttctatcatttactggatggaggctctttcatgacaattagggtagtcaccagtctgattacaggagatgaacagttcaggctacctatccactattattgagagtcttagctggtgtcatccttgtagatttgtgagagttttcctggcatcaggtttctatctgaccccaaaaggccactcacatcaagatatctcttttagtattctcctcctcaagcctgctcccaaccctatccctcaggatcccatccaacctactcccagtttacccaggagatctccagtatttcccctttctagggaaatccatatgtcctcatcccccttggggctttccctgttacctagcctctttgaggctgtggactgtagcatggttattctttactttaaaactagtatctaatcatgagtgcttacataccatgtttgtcattatggatctaggttctctcattcaagataattttttatagttccatttgccttcacatttcttgatgtcattgttttaacagctgagtaatactccattgtgtaaatataccacattttctttattcattcttcagttgagggacatggagattgttcccaggttttggctattatgaataatgctatgatgaacatagttcacaaagcatccttgtggtatgattgagcattctttgggtatatgcccgagattggtatatttgggtcttgaggtagattgattctcaattttctgaggaaccaccatatcaatttccagaatgtctgtacaagtttgcactcccaccagcaatgctggagtgttccccttgctccacattctctccagcgtgagctattacttgtgggtttgatattaaccattctgacaggtgtaagatgcaatctcagaggcattttgatttgtatttccctgttggctaaggatatttaacaattctttgtgtctttggccatttgagattcttctggtgagaattctgtattgatacctgtaccccattttttaaaattgagttattcaagcttttttgatgtttggtttcttgagttctatatatatttggagatcagccatctgtcagatgtggggttggtgaagagtttttccattctgtatgctgtcattttgtcttattggcagtgtcctttgactttagaagcttctcagtttcaggaggtcccatttattaattgttggtctcagtgtctgtgctactggtggtaatagtcaggaagtggtcttctgtgccaatgctttcaagtctacttcccactttttcttctatgggattcaatataactggatttttgttgaggtctttgattcattagactgcttctgcagttatgtgagtaagtatgctttcataatgtaggacttaggaaaatcagaggcttcctgttgggaggggttggaatctattactgttatctgcttcctacaatttagctcttacttgcctgtgcatgtatgtttatacagtgtgagtgtgtatgtgtgtatgtgtgtgtgcgcgcacacacttgtttgtttgtatatatgtgtgtttgtgtggtcaaaattcaaactccagtgtcattcctcaagagctattcctcttgttttataagattgtcattcactgggtcctaagaatctccaagtaggctagggaaagtagctagcaaggctcagatatctgcttctgctgcccagcactgggattacacatttatgctgctactgttgtgtattgagataacataggttctcaggcttgtgtggcaagtactctatcaatggagccatttcccctggcccactattggccaagtggttaattctttaagaccaagtcctttcccccctttctctaaatacacctaggtggaccctggccttacacacataaagtagaggcctgtgatacttctgtttaagaatacttgcaggtacctttacagaaacaaatccactaaagagaagcacttgtgaaataaaggcagggacatggactttggacccctagattctctgtggagaagggaaatgtggagagcttgtcagagctctgtggggggacagttatcctttctgcagtgtagcagaaaggctattttctgtggtacttgacaggtgcatgagttctaatccttgtatctattttgaaactttgcttgcccagggagcaaacatctgtctgggaacacagataggcagtgattcaaatgctattccttgctatcaggagcgtggtagattataactggtgattagttggtttcaaatttggaataaagtcattgtaatcagttaaggagggaggtctttcagatctttccctctgctcattaatatcatgttatgatatttccctttgcaaagataaaccttccctttcaaaagtactcatctgctctggttctcagcagaacactaactcatattttctttgcttttactctgagaattttaaactgaactctacttgcagaattttttatctgctgactacagattaggtgcatctgccaagcatgctgtgttatgttaattttaattctagttcatcagaattactaagcatgtagtaactttgaactgaatattttattgagtttcaatactggtaaggttttaaatttgggataaacttttaaatattagccaacaaattttaaggactttgcattataacctcccagtttgattacatagaaaaatcaatgattcaaattttaatgtccataaaagtaaaaataaattttaaataggactttaccattttacatacgatgttttatatctgcagaaataaataatacttctgtcttcatttactttcatgttgtggtgatagaaaatacattgaagtaacaccttaagaggggaacggcatattgttcctcacaatttcaggtgtcagacattgtggagatatcaacgtagtaagaacttgaagcagcagttgtatcacatccacagtcaagagcagagagaagaaactcattgcacgcttgcttgccctcacctcctttctccacacttagttcagaatgtcttgcccagggaatggtgccacctacagtagatgacgtctttctacctcaattagataattcccactgacatacctaaaagccaacctcactcgtagaaactccttccaagatgtttctggatcagttggtttttagtttcttgagttcgttgtatattttggaaatcagctctctgtcagatgtggggttggtaaataccttttcccattctgtgggctgtcattttgtcttgttggctgtctcctttgccttacagaagcttctcagtttcaggaggtcccatttattaattatcaaactcattgtctgtgctactagtgttatgttcaggaagtctcttgtaacaatttgttcgagggtaccatctaccttattttctaagaggttcagtgtggctggatttatggtgaagtatttgatccatttggacttaagttttgtgcacggcgacggatatggatctatctgcagtcttctacatatcagcatccagttatgccagcaccattttttgaagatgctttcttttttacattgtgtaattttagcttctttgtcaaaaatcaggtgttcataggtgtatgggttaacatcagtattttcaattcgattctattggtctacctgtctatttttgtgccaataccaagctgttttcaggattgtagctctacaataaagcttgaagtcagggatggtgatatctgcggaagtttctttattgtacagggttgttttagttatcctgggtctttttttcatataaagttaagaattattcttttaaggtcagtgaagaattgtgtgggattttgatgggaattgcattgaatctgtagattgctgttggcaagattgccatttttactatgttgatcctacctgtgcaagaacatgggagatccttccattttctagtatcttctttagtttctttctttaaagactcaaaattctcatgatacaattctttcaataaaagggacacagaactatagacaattctcaataaggaatctaaaatggctgaaagacacataagaaattgctcaacatccttagccatcagggaaatgcaaatcaaaacatctttgagataacatcttattcctgtcagaatggctaaaattaaaaaaaaaagcaccaatggcagtttatgctggagaggatgtggagaaaggggatcactcttccactaatggtgggagtgccaactcgtacagccactttggaaatcattatggcagttcctcaggaaaatgataatcaatctaccacaagatccagcaattccattattaggcatatacccaaaagatgcacatccatacaacaagaacatccatttaaacatgttcatagcagaattatttgtaatagccagaaactggaagcaacctagctgcccctcaactgaagaatggatggagaaaatgtggtaagtttacacaatggagtactactcagcagaaaaaaaaagacaataaaaaacaaacaaacaaacaaaaaaagacaatggaatcttgaaattcacaagcaaatggatggaactagaagaaaccatccctgatggctaaggatgttaaacatgtccttaattgtcatttggccatttgagattattctggtgagaattctctgcaccccatttttaattgggctattttgtattttttgtgtctagtttcttaataaattttggagatcagcggtctgtcagatgtaagattggtgaagaccttttcccattctgtaggctgtcattttgtcttactgacagtgtcctttgccttacagaagcttttcagtttcaggaggtcccattgattgatgattgctttctgtgtctgtgctctcagtgttatatttgggaagtggtctcctgtgccaatgtgttccaggctacttcccactttcctttctctcaggttcaatgtatctggatttatgttgaggtccttgatccacttggatttgagttttgtgcatggtgatagatatgaatctatttgcaatcttctatgtgttatcaaccagttatgccagcaccatttgttaaagatgttttcctttttccactgtagcattttggcacctttgtcaagaatcagatgttcacaggtgtgtggattgattgatatcagggtcattgatttgattccattgatctacctgtctgttttagccaataccaagctctttttattattataactctatagtatattttgaagtcagggatggtgatgcctccagaagttcctttattgtacaggattgttgtagctattttgggttttttgtttttccatatgaacttgagtattgttctttcgtggtctgtgaagagttttgttggaattttttgatcgagatttcattgaatttgtagattgcttttggtaggattgccatttttattatgttgtttctacctatcaaagagcatgggtgatttttccattttctgatatcatcttcaatttctttctttagggacttaaaagtcttgtcatacaggtatttaactagttcgggtagtgttaccccaagatattttataattgtggctattgtaaagggtggtgtttctctgatttctttctcagtgcctttatcttttgtatataggaaggctacttttttttttgagttaatcttgtatcctgccacattagagagaacttttaaggacaaatattttttgggggggggtttcgagacagggtttctctgtgtagctttggagcctatcctggcacttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgtgtgtgtgtgtgtttgtgtgtgtgtgtgtgtgtatgtgtgtgtttgtgtgtgtgtgtgtgtgtgtgtgtgtgccagtgttcaacattgattgtcttcctcaatcaatccttacttaattttttgagacaggatttctcattgaacctggggcctactggttcagctaggctgttgtgccagaaagcctcagggacccacttgtctttgcttcccagcattgggattcaggcatatgataccacacctggcttttatatggatgcctgaactcagatgctcatgcttttgtggcaaacactttaagcaatgactcatctctagcacctcaccatgagagacactgattattgtgtagagttgttttggcccatacctgtatggacactactggcttcaagaaaccaaagatgctgctgagcactcacaggttatgctggacaattcctgtacttcaccctgtcccacagtatccatagtgccaaaggaaagaagctctgttgctgaaatctgagataaagaaactgtccacaatgacataggcagatttgtaagagacatttcattttatgtcagtgtcttctaattcctttactttgtgctgttggttgtttacttaggaatccctaataaacaataataataccttaaaatgtaaatgaaaaagaataacattgcatagtacatgtgttactctacattgcagtaaaaaatgtctcaatcatctagctaacagtttaacgaagattgaaatgtaatacactgtttgcaaagacctaggcagctgggagactgagagataaatagatttgaatcaaaaagtaactctgtaaaatattttttaaatgctctgtaaatgcagatgaattgagaaatgattatgcccacagttgacacagggaatgaagcttctgagaattagtaacataatcaggtacataaaaaataaatagctttctaggtgggaaagaggtaaataatatcaaagtgtcattttgcaaactattaagaggaccatactgtagtatgactgaatattccatgaatgagcatgcttcatatcctaagttcattgtcagtttctgggacaaaaaactctgacaaagaggcttaggggataaagggcttattttatttcagaattccagactctagtccattattgcatatataccaaaatggaaagaacttaaagcagcttgtcatgtcacaactatgtataatatgaatgacaaatgagttaatgtgtgcatacatattgctcaactcttataccacctaggctcccctgcctaggaaatggtggcacccacagcagcctgtgttctgttccatcagaaatcacaaaaatcccaacagacatacccacctagcaatctggtcagaaaaaccctgttgagattctcttgccaggtgattctatgttgtgtcaagctgacagttaaaaccaactatcacaatcctaggaagtggaaatggaaatttgcagcacagacatacagtaaatgtatggagtaaaccaagatgtccatatgtgggaaaatgattgaagaaaatatgacatttgtgggtatacaaataatagattattattcagccattaaaataattgttgagtgtagtatatagaattggaggaaaaaagcatgggggaggagaataatgagtaggtattacatacataatgaaaatttcaaagcatatatctatttaataataaaaaagaaatattgcaatttgaagcaacataaatggaactggaagacatgaaattaagagaattaagccaggcacagaaagagagatgttatgaattcttgttcccccaaggaagataaactaagtgctttcagagcacagattaggagagtgatcattggtgagtttgaagtgtgggttagtggtgttttctagaacagtagggtatgcatagcttactaagaatttgaagagttggaacattaaatattcaaagatgtagaaatgctaatttctctgatttgatcattacggatagaatgtatgtgtcaaattatcacactgaatcatacaaatatgcacaagtttcatgtgttgttaaataattagcacagattgtagtgatttgcttgttggaattatttgaggtcaaaacacaagtcaagagagaatgctattctgcaataaagatttaaacatctttactacaacatttgaaaattcaccgcaggaaatcatttctctttggcttaaaaatggacccttttcttcccatgatcacaagagcagtgtgtctagacacatcatgacccaaaagtatcttcagaggacagtgcatatacaactatttctttttatgaaaataactgactctcacagggataatggtctctggtggcagagaagagtggcatcaccagggacataaaaaataagaaatctgtgtggaaagacagatacttggctctaccacattttgttctttcttcacataagctctaagtggtaggctttggatagattcattactcaacttttgatgattatggaatcttgaatcttaatgataattattcatgttttttgattaaggttttccaaagttgccttgataggttaaatgtcttttacagttttacttaccttgagtgatccctcagccagctgatcctgcctgtacagaggtagtgagtgaaagacattgtgatacagataaactcttgacatgtgtccctcacaggattgataactcagacattagtaagcaagaatctgagttggcattcgatcatttaaggtattttatgaatcagacaaaagacaccctcctctcactgctctaccatgtaggaaagccctgttttttccttgctatctcgaggaactgttataggactagttaatggccatggctgccagctaagggggtggttgcaattcatacccatttacctccctttactttatgtatttgtgttgagaaaagttggaatgagaagcaggattagtaatgagcccttaatgtggttacctctagtgagagaaagaatagggctggagttggacccattatcactctgtcaacagttcttattaagatggtggcatttagacacttccctggctctcagtctgtatgtcgactgcatggacatgctccattatctctgaaggactttatttgccctcagaggtatgcctctgactctacttgtcaccatacccatgtactgtacctttctgtattacaaatctagccacatcacctcagtctgttctcctttttcagccatcagcatcatttagcaatcacatgttttgtaagatcatggatggcctttccttttaggtatctataagcattcagttctatccctatccttcatttacccacaccctggagtcataaaattaggagctctgccttgtgatggtgatggtgatggtgactttccatcctacctgcatgagctggggagaaaccattttgctttgttccaaggaacttagctttagagaacagctactctttttgcaagcaagtattcttgttcaagctttgtgggagttcactatgtcagctaacactcagtcagcatttgaaagcacactgtgtgctaagaccctgtttagatctgtactgcaagcctggttttgtatattgtgctgtgtctcagaaaaggtaatattataaagaaattaaagaaatcatatcactaggtcttctgtgattgaatcagagttaagtgttaagtgagaattctctgtgtgaaatgttgtaataatagaatttagggagcccaatgtgagggttccagggatgtttgctaaacattattagatcgtgtggttgcacagcaggtttgattatgccttcccatctcgacagcagcttttcacaatggttgtgcctatttcatcactttactcttgtaaagtgtttgcgttgtttttctgaaagttgtaagacttatctcccgtgttaggctgaatttcttgattatggcatcttgattagtcatacccgtaggtaaggaagcacttctgtttggtgattttctccctcatcaggtttatattatgattcgttttatttgattttgattagaaccttatttctgttttgactttaatgtccagtatttttgtcttaccgtagctgttacaaatattgtgtgtgtgttcatgtatgttaatgtgcattctcactctccccctccttccctccctccctccctcttcatccccaacagccccgtgtgtgtgtgtgtgtgtgtgtgtgtgtgtgtgtgtgtgtgtgtgtgtgtgtgtgcgcgcgcgtgcgcgtgcacaagcatgaattcagagggtactgtttaaaacttccttgtctatttccaacttatgagttcctgggatggaagaacttgggtcatcatgcttggtaacaagtgcctttatctgctgagctatctcactgtctgatcctattctttagttttaataaggtgatttcttagtttctcatattttgtgcttgtttcatgtgtgttacttattataaagtttgttctcttcatgcatatatattcaagttgataaagcatatagaatgtctaaaaacaaagttaaaaattaatttgtatataatgttatgatgtccatgtaactcaaattttgtcactgcaatataattcttattataaggctatactgggataatttcccaaagaataagaaatcattttcaggaaatcacattgttttaataaacagttgtcatccacctgtcattttggtagcaacttttataaattagtatttatgggctccatcttaacaaaaatatttcaactaataaagacagttgtttgcaatcatttatggattttctttagagattcaggacagtgttagcagttctttttatcttgctgaccggtggagatgatatgctatttaactctgttcagaatggtcttacctatgcaaagtggataaagagcctggagagtgtccttgacgttcttgacctattatcgttttaagtgtttcatgtgaggacttccatttcaaccaagctgcttgagtgggataaaattgaaaagtaaaatgaattctcttcccatcattggttgttatatattagaactagagcctttaattagcatataagtgaggaaagtgtcatctccttcttaaatagggagcattctcatctggagaaggtggcagctcttacattaaaacctgacttagcaaggtttctaacagttattcaaaggccattctatctgaggatgaagaatttaaccaaaaaggtagtgttatctgatttagcattataatggaaagaattggggaaagaaaatagctatgtaaaaatatgtatgaatataaaaaaaatggcaggaactaaggtaaaaaaggaaggtatgtcacctagtttttcattgctgtgacaaatgtacctgacaagactcaattaaaggaagggatggtttgttcaaacttatagcttgaaggaatacagtccagtgtttttgggaaggcatggcagcaggtgtagaaagctgctgattgcattgtacctgccatcaagaagcaggaagaacaaacaagaagtagagttgagctctaaattctcaagcttcccagccatacatttttttcctgaatggcttcagctcttaaaggttctaaatagcacctttcctaaatatcatcatcagctggatgtccagacatgagagtctgtgcaacatttcactctcaagacataataggaaagaactatatttttctaaagctaattattatttacaagaaaatcagactaagatgcaagtcttgaagagctattatcaggattagaattcatggaatgaggtgtttggaattcaaaaaggaaaaagagatgggggaaggaggaggaaggatggagggggagagagcagcctgacttcacgacctttacctttgttaagagttggctgctgaataaggtcattgcatttcttttgcaagcaggggaaatctgttagagtatttgagcatctctaataatgtattattctatagtttagtaactaactatatggattgctaacacaggtttacataagctgagaagctgattgcagtaacctagcctgatgtggtgatatattgtttatgatctaataaagtcaatgaagattagaactcaatgctagccacattagacagccacagaatttgggtagtgttgccacacacctttaatgccaggactcagaaagcagagacagatagatatctaggagtacaaggccacctagggctacatgagagtgaatcggtctaacagagaagcagagctcacatctttaaccccagcactagcgagtcatctaagaaggagaccagggtctcatgcagcattcactattcagtctcagagcaattagtctcctccaggcatgttgaggtcaggatctcactgactttggtagaggtcagagctctcttgtgcttggccaccttgcttttctgatcttcaactttaaccccaatatcaatactattattggtactacagcctggtgttaaaaagaaactcaaaccagtatcagggtgggttggaatgtagagttggaataaaagaaagtgagaacatgaatcaaaacaccatcctatgcgttctcatgctcctcgtgccatgtttccaaccacgatggactgtccctgaactgtaagccagagtaagccatcacttccttaagtagcattttgtcacatcattgagaaagtagctaatatagcttctctttgtctctaggagatgacatgattctggcttctcacaaagacatcaccagtgaatatgtatgagtgagtggtgtcttgagtgacaggagagcccattttatgtagtcaaagctcttaaactctctttcactgtccttttccctttcaaaaagaaattccacagaaatgttaaggttgcttttaaatttatgtcatctacttcacagggagtattccaatatagcagctattaaaaattctaatagctgtgtgtttctgtatgagctgctatttggtgtatgtcttgcacatattcacttactcacacatgtatcccccactttatttttcccaggcctggggatataatacaaagccttgcctgcaataggtaaattttctcagtcccaaccttcatcctctgctttctgagaaatgtctcagtgttccataccaatacttcaattatttttatgtagcttttagtctggactattgtttacctactatgggctgagtgcacctggaggccactgtggtagtgagatgcctttctgtactcatggtaccggtgttatacctttcagaaggaaagagatccagggttgctacaatgttctcacttactacttttgatttaaaggccatgtgctgtttaattttctccaaacttgacacaagtcaggggcatttgagaagaaggaccgtcgactgaggaaaaaatgcctccatcagattgttttagagaaaagtgttgggcattttcttgctttaatcattgatttaggagtacccagctcaaatatggatgatgtcaccaggaagaagtggtcctaggttgtataagaaagtaagctgaacaagctatgagaaacaagccagttagcagcatctattgatgtctgctttaattcttgccttgctttagtttctatccaccttccctccctcagtgatgaactgttaacttgaagtgtaacatgaactaaaccttttcctccccaagatgctttttgtcttggtgtttttcagcaacagaaatctggctatgaaaggcttcatgtagtttttagaggtattaaacaaaagcacatgccctggctacttctgtgtggctgcatggtgagatgccaagtctagctgagtttcacctttgtttgaaataagaacatattggcagtctctcaatggttatgatttgattgattagttccttgtctagtggcaatgaaactggactgaagacagagtggtaagatgactgttcttgacagtcaatacgtttagttaaacggtattgccttgtgtctctttctgtagttgctctgtttggattgcagatatgctcaaggaggtcagagaagtagatttccgagatgcatcacatagatatctcttggactttgattggcctaatttctccctcctccccaatgccaaaggaagaataaattgatgttaagtaaataaatactgtggaagatgctacaatgagctccataacttattctaatggtagctcactgttcagtctctcctctgcattttctttatctctttaccaataagtggtaaaaatgtgatatgtacaaataatgcagaaaggaaaacaagggtctgactggtgagcctccattcatcagaacatttgaatttcatggcagaggttgggaaacattttcggtaattagcccaataaatttctagtctaatttcacatctctgatgccgtgaaataccaaccacagacagtgtggatgtggctatgtttccattgcaggatgtttggattctgtgcaatattcctgtgttgtgagctattaatttttacttttttaaagcaatcattattgttcttggtttcgatactataaaatgcaagtgaggattttgtaaaacttaatagccatagtttatcaagcaggggatagaaagaacaaaacctttgggcatgaaggtttgacaatacttacaatatataccatgtataaattcttactctgtttgccattctgcaaagtactttatacatccatcatttaatctgcaaaggaattctgcatgtggcattcttaattcaatcttttgagaactaatagtaactcaggtaactttggaattattttccaattacaatgtgattctggtaaaccaaaaaccttgtcttcagcagcttttcagatgaaattaataagtgaatctactaacgtatgaccttgcttcctgattgtaatttctttttttaatgacatgaaagagactagagtgatcatgttcaacatatttttatattacttacaatgaatctacaataaaatttgatgctatgcttgatttaactatccatgaaattgcctaataaattctaaaaaaattagctctcctgggtcaggtatctgacaaggattagggggccctcattctccacatttccccacattagaattcttgttctattaacccatacttttatgaatgaagaaagcttatgtaactttggctgtgactctggataaagcaatagacgtgacttatttctttttctttatttttgtattgtatgtgtgatgtgaatgcatgtatatgaatgggcagcggatgtggatgtgtgttgggggcatgagtgtttatgtgtccatgtgcatttggagggctcagttgttattgggtggctctcctaattgctctccatctcattgagtcaatgtattgagtcagtatctctcacttgaatctagacctcatcatttgggatattctagttagacagcttgttgcagagattcgctgtttcacatattcagagattgttggtgaccgccacgcccaatttaggagttatactggtgcttgggatccaaattctggtcctcacactttacctgacaacacatttcctcaacctcaggcatgaattatttttaaaaaaattagaccccaatagtatagaaaacatgtatctttcccattaaataatactgttgaagggctggaaaatgactcaataagtaagaacacttgtagaagaattaagttcattgatagcaccaatatccaggcacttaaaattgcttcattgggaactaatgcacttttaatgcctctgtgggtacccctgtgtgtgtagtacacacacacactcactcacacacacacacacacacacacacacacacacacacacacacacatgcaaaatcataatatgagtaaaagtaaatattataaaacttactctgtgttctttaatggattattaaagtatgataaggcaaaaatacatgtatgagaatgcccccatctttattttaagtgttttttttgggggggcatggcaatgctggtaatgggtagcaagggctagggcattttcccttcactagtttaacactacatgaacaaagtgaagaaaattcaaatagtacatatgtgttttataataagaacattatgtgctgattattgtgtgagctaagaggcaaaattgttaatttattctcttattggcccagaaatggaaatttttcaccatattatccttctgtttggagtcacaatctccagggttaaactcagcttatgatgttcacagtctgtcatttctccaatcaatagctagaaaattgtgctctaatggtaagcttaagatcctgtgtcatgtctactttgttgtatttataaattttatgcaaagaacaataacactagatagctatatatgaacacatacacatttacttcctaaatattgtcttgtaaaatcagttctttacagtaggtactacatatttttgaaggctactgttttataaaaacatgtcttatttcttctaagtatttttatttatttgaaatttcaagcatttataaagttatttattcatatccattcactactacctcccaacaactccttttaatactaccaaatcatttcctttttaacattataacctctttctttttcattaataacccgctggatctaatcaatgctgcccatatgtacaaaggtgtgttttttagagtagtaaattcacttactgaatgtcaaacttagtgctcaaaccagagtacatctgcaggaagccacactactattatcattttaccctcttctacctaatatctttgatgtgaatggataccaacttagttttggaggtatgatgaggtataatgaaaaaacttcttatgttttactataatatattagtacagtgaggtagacccgagttttagtatgccagcaccaataaagtgggaaagaggatggttataagttgtttagaatatttttatctaagttttcaaatgaattttctgaagttgcttttatattaaatttaagtataaatctcatacttaaattttaagtctaaagattttaagtatgaagatttaaatatgaagctttaggtagagtaaatcacatgaatatggaatagaagcacacagtgccatttattctttcagtcatttactagttttagggtgcctgctatggaccatgccttgagtgaggccattagatacatagtgatgagcaacgagatttgagctcatcaaaagacacagtgggttaaatgctcaataagggttggagatgtggctcagtgggtgaagtgcttgtcacactgacacctgaagacctgaacttaattccacacaagccacttaaaactggatgcagaagtacacatctgcattctaagcatgtctatagagagatggaaaatggacacaggaaagcactcattcatatatgaacgtgtacaccacagggtaagacagagagaggggcggaggtgatttcttaaaatgcttactaaagcacttatgtctaaagggactaataaagagtgaatatacaagacagtctgaattttattggctgatatagaagccatgcttatacttgtgttgttggagtggaagaagtaaaatgggagtgattatgatcacaaagtgttcatgggattaattggccaagtgattagctgatacgttgatggagcatatggacaggttagcaaatatagcagagtaaggagatagcctcaattaccacaaggagctgttagtctgcagtgctgctcagtggtgctcatagagtctgtagttttctcagacaattgaactcattgtcttctttgttgacctccctttaaagaatccttctattgcatcctatccagaggactgtattccctgtcacactgactaagattataaacctcatcggctgaggtttataatggtactgtttccctccctcattttgtaactttaatggtgtcagttgaaaggcaatgccttctctgtttgcctggacatattcactgcctcacatactgactctcaatacatattcctctgatttgtaagtaattgtaagccacctacttcagtcatgggtcttgtgcaagggcaatatacattcttattgacttgagtcttctctctggaacatcattgttattttaagaaaattatgtattaattcacttgacacttgttatccaaattggatccactgtgtcctttaatctaaaaaagatgcaaaatccttcctataaaatgcctaaagctatttgtgtaatctactgacatagttacaatcaccttaaattatttctagcacccagtgtaacataaatttgtatataaacagtttctatgctatattgttgaggaaataatagcaacaaaataaagatgttcacatgttttgtgtagaagaattaattttttttagccttcagttgaactcatgtatgtgaaactcatagataatgaggtccgacgatttcaaagaaagtttggattgttagaaatgatagagaaggaaagccaagaataaatatgcaaatgggtttgtagtctttgtaaaggcctttcttctacttttttattaattaaaaaatatatatgtatgtgcatgtatgtgggagggaatatgcccatgaatgcagtacccatagaggccagatgagggccttggatcctctggagctggagttggagttggttgtaagtggtaccgtgtgagtactgtggactgaacttggaccctctcaaggtcaatatgtgttcagtatctatctttccaggctgttttgttaatttttaattttcctggcatgtacataaacattatctgctagagaagtaagcagtcaaatgactatccatctttctacctctgactttgcattgtcctttattttttacaagctctgctgaacctggagagatagaagttttaaaatattgaaaagattcaacgtagggctctcttggaacaacttcacaggctttccgttgtcttgtgaagattttcacttgctttgtttatcgaatgtcacttgtgaatgtctgttgcattcatcccattgtcatcagtattagtactgagaatgaacaatgatgagacattgtcaggatgctaacatcttcctttcttcctgttttgacattgtgattgaaatatacatgagcactctatcaaatgagctcccaacagtccacttgtcagcaagtggctagctctttatgtgctgtatatgggtatggctctggctttctggagaagagtaggcttgcttgtagctggcgtacaagcaagggtgaattcatacatggcttccatagttaaggagcagaaagcattcttgacacaggctttctgcttactgttctccaactgagcctgatggttacacattactgtctctggccacagtggatgcctttatgagtgttctagcagtactagctcctactacactgacttgactttgacgtctaagcatcacctcatttctgctgctgctcatagtaccgaagtttagactaatactcagggacattgtgcctgaatatgtgcactgtacctgtgtgtgctttcttcttactaggtcagaagatctgaatcttgtctccacatcctttaagtattgcttctgatgggaagctttccctgtataatttggatatcagcatggctgcaacatggattgcctcaacctctatcccaagtctggtgcatgggttattactgacttcagtcttgtaaaacccaaccaggaatatcatggtacagaaaggcctatggcagcaccagcatcactctctatctggctttctgagtctattatccattttctcctcacttacctcagagttttttattttttgatttgcatgcttataccgtgataggcagtacatagtagtgtacagaccatggaaaggtaaccctggagtttatattatggttagatgctctgtacatccctggagatgtctgtttattctcttattttaggttgttgtttgttctagagccatccctgggatagttagacagagcaggctcagcactcctttttaatctaacaactcactatttggaattctttcatcttctcacattaatgacttttgtaatctttccattaaaacatttattactaatagatttaacatggacctcccacagtcctccttccccccttgatacctgctatgtgtgtccatgaagaagtagtcaaagccatttaatgaatggatggtgttgctaatgaagtacatgtgaacccagttacctctcacttctgctctagaccagaggacccattggtttgtatctcctcaaagtgggactgcaaggtcaggctaactttgggaaatatgctgccataaagaactatactctaagtcaaactggcactgtcttcatcaaatcatctctgtgatttgcaaaagttcattgtaattgggcatgttgactgttgatgtttctccactgaaggagaggcaaggagggtctttggacctcaccttatatctagtgtgggggaccgaatatttctgttatggaatattttggggcccagtctctagctcctgtaaacaggggcaccggaaagctcctggtcaccatagtattgttaattgccagtagggctactactgtttaccatggcctcagggtaatatgcctcctaatttgcatctctgtagcttaagccttgagtaggcccatgcctgggccgaggactctgcctacatgaccaagagttgtttaggtaatagaatcacttgatgttagctatatgcattataatagatgcttcctgatgttcctgcccttggaggactgtttaaatggacttctcaataaactgtggctgctcagcatcagctgggagccctcctgagttgatatggtgtttcctgtctcatcattagcatcgctgggtaattaaactttcctagtccacacacctccactcagaatcggacctgggactatacggctggctcctttcacagtcctgaagacatcggtcccgaacaatctagccactctctttaaccagttgtatcaagttttaccccaatttcatccaaattcatgggtaagatttgactatataggcaagaaatatcttagggaagggccctatctatgtggccatggatgtgtcatcatatgtgcagattcagaacttctagtgttacatctttaaggccactcacattcctgcctatatcccctcacccattggtctgtaagtatgcctttcgaattcattagctcccaagtgtaaattttggtgaaatcatacctcactttgtttttagggagacaggtgaatggacattgtttgggtttctaccagagaaagaatttagtgacacatgtatttgacatatatatatatatatatatatatatatatatacacacacacacacatatatacacaaacttagccaacagtttgtagatatccatgaataacttttttgtagttgttaacatttaaataacagcttttcatttttggctctgggtaactttaactcttttgattagaaaacactgaaatgaacttctggtgaatttcctatcagatatctatatctatctatctatctatctatctatctatctatctatctatatgtgtgtgtgtgtgtgtgtgtgtgtgtgtgtgtgtgtgtagctttagttaagcatttatatttctttctatatagcagtaatagagatagattgattgactaatatataaatcactgattagagaaagaagaaaatggaagatctcagaacacatattatgatttggtttgtaattgtgagttaaaaaaaatcatggctataaaaaaacaagtcagttttaaattgtctaattaggcaatcagttgtgttgcttatctgcatccacaaagagctcataggaaaccggaagtgactacatgttgcctaattagtccaattaaacacctgcctaagatttcctagcttacaaaactccccactcttaaaatgactagtgcactgctaaaaatataacttccaaatctaagtgttttatttgaaaaattggggaactattctcagaatactgtatgaaaaaaatgtaaagaaaatacatgtgaacttttttcttcagctttttaaaagaagtaacactttgtttccatgtttctcaaatccagccgactgagttggttgctttcagagtgttagtcaaagagaccacatatcatatccccatctgagtcctccaagtctttcttgatttcatccttgcctgggagtagagcagtggcagaaacagcagtggtggtagcaggctcagcagcagcacctaggaacacagatagctcagacaagaagccttgaccttttcagcaggtgtaatcagcctccaaagacaaaacaaggaaccatttatgtccactgatgatagaatgtgatacgggagcaacagtaagcaaacataagctgacaacatcattagcattctccagaaagaagagtttgcagattcttgagggttctttttattttagagctgggggtaaaaagggaagcaccaagagtttgattggtttcagtaacacacagtgaatgcatggctagttagagttcacatccaaatattcccagccatcaccttatatgtcaggatcctgtcccacatggttactgattatacatccaatatagtagtagatgtcactttagttaccgagctaatgtgtctcagataaactgctgcatttaacattcaaaatctccctgggaattcaatgccattattatttcaaaatagaaaagtgaatatgagattcagtctttttccacccagataaggagtggaagtctccagaacctggggaaattgctgtggacctgaggtagattctccaaaactcacctaaaaactcagatgtgctggctagatttcattgcactcaaagatgctatacaggttactggtagacagaagctatgattgatttaccctgcagtgggccatgcatgctacagcactggtctgtcaggaagttgtaatagttgcaagactgtttggaggctaaccaattgttttctgattagatttgaggcctattccaaaggagggaaatcatgtctggtgtgaccaacctggctcaaagatcatcactgggcaggtcataggccttggtggggacacctactactgttgttttgtgagacagccatggtgttaaactgcctgttaaatatttatgttagtatctgtcgatcagcactgttcttaaccttgctcagagaagcttctctttgcagtggacagcagtggatgcagaaacaaagacctggtcaattttctgagagcaagtggctattgagtgtttgccacaaaacgagacatctatagcaacccacctaaaaaattcagggaacatcgcagaagagttgggaagaattaagagataggggatgcgaaagagggctatgacatgttgtctcctagacaagacatggctgttgaactgatgttgaatttatggctacttaaacaagagctgtacaagatgtagactaactatagctgttttgtaatcttttatatttctgtgtacagctatcagattgtccatgttcttataggaaaccctaactaagacatttaaaaataagtaagacatgaaagttggaagggtacttactagccaggaggaggggccgaggaagtgggagtgaggatctagacatggatgtgatcaagatacaatgtatatgggcataaaatcattaaatatatgtaaggtattacagatatataatgttctttggctattccattcatgtacaaaatgcattctgattactgtcccccttttagtctcctcctcctcctgttaagcccctcttccctttcaatcattcatttcttgtttgaaacccactgtatacacacacacacacacacacacacacacacacacacacacacacacacggaaatctccatagctgttcctctcttccctagatcatgtttctcccttttacagtcttttcacccaacaatgcttcattcctgatcacccaagtcccatcctacgatttctgtgcactagtgttttaaagagaaattttgtctgtctttagatagaaaatgaggtgcctcttttttacaaattgtccaaataaaggtacagaagaagaatcttgacaagtataattacatcctgctcatttacccctccttgcatcaacaaatccccagagccttcagagaagcaaagcttaaggagcacggtgcacaccaaggcagtgcattcaagtgttctgtccgtgaagctgacccacagtaaatgtcaacgtggtcttttctcatgctattggcatttcaccagcagcttgtagtttaatgggagaacaataatgtacacgtacatatcaaatccagaaaatgtcagcagattatgtaattatctctttgaaaggctaggaattcttttaaaatagagtatgtccttcatgctctgaggaaattctacagacacaccagttagctagccataagaacaattgatttttcacttcagaaatttatataatatgtctaatgggacaaacctatactcactattggcttaagggataaacagcacatgtcaaataaatcaagtcttcaagtatttgaaaggtcctgccgcctctattgtgcattttaaaaatctttctttgaatttgttcttgggcaattctattcatgtataaattacaatctgattactgccctctccctttctagtctccttcccacctctgttaagcccctcctccctgcaattccctttcaatcagtgggtttgaagcccactgagtttactcgggattatctacataattgtggatttggaattgtacattggaaccttgtgagtgaatcagagtgtataaagctgaatacaatgacagtttctcccccataatctgtaagtaaccagtggttaaggtccaatgggaacatccctgttctgtggtgggctgttagtaggctcactcttgtgtatatttattgttcatataaccacagatgctgtgagaacgtgacagcattgtctgtgcaagccccctaagatagaatctcacagccttgctcctcttctgcctcaaagtgctttccaccctgtgtacttaatgattcccaagcctcagagcagatagtaaaaaatcctctaacatgcagtttcttttcaactgattcaagaccttctcctagaaataaggacagtacttttaattcctaattcacaaacacactatgtgtaatgggctgggactaattggagagtgttctgtatttggattccattaaaaatggacaaagtgtcactattaataatttgatatttttgattctagaggagaaaaatctagaattaaaatctttcaatcactgaaggattaatattttggaaaacaatttctattcattgttttgtgagatattttctgggtgtgcagatggggaaatatgactttcttgttgctcttagtaggttttgtcaagtcctgtcaagttcaaaagtttgcaagtgctagacactatatatgagaacagtgatattgtctccatgccaagaaatgctaattgattatatgtgtgtgcatatgcacatattaattttatatttaatttcagctattattgttgactttattaatacaaaaatcagtcatttgattctctaaaaggtgacctgaaatttagcttttctatatattctagttatcagaatttcacaacaatatatgtaagatatgtgtcaaatagaaaacctgcaaaagtcaaggcacaggcatatacagagatataaaattataggcaaagatttctactgaagtatgagggagggggggggggggggaaggagggagggagggagggagagagaaggagagagatagagagagagacgactttgtgtctttattgaagcaagaaaatgagtacattatatttaccttatgagttgatgcttttgtttactttcaattgtatatttgagtacagttgcacactgaggccagaaaatggcgtcatttcctatggagctgtagtcatagacaactgtgagccatcctatctgaatgctgggtgacaaactagggtcctccggaagagtagtagcaagtgatcttaaatactgagccatctctccagccggtgtcaaaatgatgtttatagttgtgctgtgctgctgatattttccttaatacacttaagacatttagtaatattaaggaggttaatcctatgcacccttattttggagtagctggtgagtttttataactcaagatgatcatgatattgcacattcgaactacttttgttttgttaatccctagaaggtttctttgttgtggagtttgccacttttgaaagttgcctccaactgataaatgtactaagtatgaactctggctgacaagtgagataacagttgagagggcaagtaagaaagcatgtccttcacctatgttaccaccattgctttggtgatgatttagaccaactccttctccttcgtggtgccatcccctggagccttgatctttctcatcacctttccatgatgtgtttgatgtgttcctgattcttcaagattactttaatctgcattgacattagtggttactgtgccagtcctctactgagtaggtctaagtgacaagaagacttatgaaaagtccctccaatactttctgatgcatgtgttcaaattgtcatggaattttgctgatcattttagttcaaaggaaagggacaactttaaatttctttgcaggagaaaactttgtttttatttataaatgctagttatatgaataatattttcaatttttatcaaattattctcagatactttcgtatacatacacaatgtaatccatttgatctctccacccatcttctcttatctcccatccacccctaccaactcccacacctgtctttcctaattgttcctttcccaaatgcatgacttttcattttgttaaaagacccactacctttaatcaggtaatctgtgtgaacacaggtatagactgtgactccccatttccctgaacctatctacaggaaatagttcaacaatgagaaggacagcaccctgaatccctcttacatccttttcttgctgttaatgggctcacttttggtcaggcacagtgtaataatctgtagtagttgaagattcattattataatagctacatattgttgggaagatggcatttcagtgcccttagtctccctccccactctttggtgtgatcagaaatagcagatgcaggcttggcataatctcttaacagttgcaacacttccctataagtgcatcatgcctgcaatctatggatagttgagggacacttaaaatacaaacaatgatgattaaaaatactagaagatagtaaacaggaagtgcatacagggcctaaagaggccggaagagggcatcggatcaccagaactgggattacagacagttgtaattgtgtaggtgctgggaaccaaacttgggtcccagatagggcagtaagtggtcttaactgctgacccatctctgcaaccacaaagaattttttcagttatttctgtttaagtgtatgtgtgtcagtgtaggccatgtgtctcagggttgctgtgaagagacactatgaccaaggcactcttataaaggaaaacatttactggagtgtctcttacagtttcagatgttcattccattgttgtagaggcaggaatcaaggcagcatacaggcaggcatggtgcaggagaagtaagatctgcaggcagcagaagtagatagtatcactaggcctagattgagcatataagacttcaaagactggcctccacatacttcctccaactaggccacatatactttaacaaggccactaatagtgccactgcctatggaccaagcattcaaacgcatgactcaatgggggggcaatacctattcaaaccaccatatcatgtatatgtggcgggtgcccaaggcagcaaaaaacggctgtgggatactcagagctagagttacaggcaattatgaagggccacatggctctaagatctgaattctagttctgtgcaagaccagcactctctcctcttaatcgtctcccttgatattttgtaattgacatttcttacatttggtaatgagaatttcgacttgagaaaaagcttgcatctgacttgaatgactttagatttgtgatcaggttctccatggtgtagatgtgaaaacatactctgctttttgaaatactgttcagaagctatcaagttatacctaggccattgaaatttcatttaaaaaatggttttcttttactgtatatgaacagtcatgaccatttaaaattgtctcataaggaaaagaggaaatactaccagcaaacctaaaagctttaatctacacaagattgacataaaatattgaaataataatctaaaacatcaaagtaaacagaatgcattgtgtagtgtgtatgtgcacatgtgtgtccatatgtagtccatgctaataagcaaatacttttagcatattcatttgcatatatgggaataaaatgctttagttatttagcagtcattcattcctttttttcctccattttttattgaattagaaacaagattgttttacatgtcaatcccagttccctctctgtccccttctcccctgtcccccactaacaccctacttatcccaactatttctgctccccagggagggtgaggccttccatagggagtcttcagagtctgtcatattctttgggatagtgcttaggccctccctcatgtgtctaggctgagtgggctcctatgctaggtataagtactgatcgactacaagaggccccatagatttctgaggcctcctcactgacacccacattcatggggtctggatcagttccatgctggttcccagcaatcaatctggggaacaagagcttccccttgttcaggtcagctgtttctgtgggtttcaccagcctggtcttgacacctttgctcattcctcctccttcctctgcaactggattccagttcagttcagtgtttagctgtgggtatctgattctacttccattagctgctggatgaaggctctaggatggcatataaggtagtcatcaatctcattatcaggggagggcatttaaggtagcctctccactgttgtttagattgttagttggtgtcatccttgtagatttctggacatttccctagtgcctgattctctttaaacctatactggctccctcttgtatggtagctctttttgctcttcgctattcttccccctacacaaccttcctgctcccttatgtcctcctcacccctcctcttctccccttttcattctcctttactaataacattatatacctcataaaccatgtgtagatatttaataagaatgatataaaattttcaggatgatatttactaactacaaataatatgtgaatacagttaatattagctacagtgcctggttgctcattaaaatctcacacatatagctgattagaaattttcttcttattgcaaaatatccacgtgggcttttctcactcatggtctatattgctccaagggaaaggaactctgcatttttatctttagtagctggcctccaaaattgccggaagggtgatcataatagcccaagtggagagacccgcacattgcactttgtcatgtctgtaaatcaaccaagtcatctccaggtgaggctggcaaacccccacattcagttaggctgtctgggaaacaagttccagtaatgcccccccccccccgccagtctcctcttcagtgccggtattactgttgcctgcctcttttcctcactttcgcatagaatctcggggtgaaactcaggtccttcagctcctgcaaccaccccataaacagcaggcctgtggtgacatttaggggaaggcaggcttggcttaactcagtcctttaattagagctgattggaaaatattttgtatttatcctggtttcatctttctttctagtctcctttgagcagtctggttttgttttgctttaaagttggtaaatgcaaaacagtgaatcatgagtcgagtggagtctttccctaattattttagggactttctagacagcatgggttttctgtcatgggtgctgatgactaaacaacttaagatttttaaaaagacaaatgccttcctactcactttatatttctcgttcaaaacatttgctgctttgctgagaaaaggcattgctgctttgggccacagaaggacactgtgatcagcaccgagtatatgtggcaccgagtcccacagattcaaatagatctgggagaaggatgctgcctgtaagtactgctgtggtgacatcaaggctcactggggttacctcagtctgtagtggtatttgcataaaaaagcagtgtttccacatgtttgcatgtgaacagacttaccatcatggtgcagtttaccacctctagtctgttgttctgtttgagtcagtagcattggagaaacagactaacatatagggtctacaaatttgtaatatttttcaagtcattataaaaataagtcataaatattacaaatttagtggccacagataaaattaatactgtttcaaggaagtgccaatatgttagtggtaacatcatacaaatacccatttgtaatgacaagattgtctcatcagtaactgctcagtgtccacgctgagatgcctatatcaattggtgtttgcatgctaccattgagaagagaattacacaccaagtcaataaggacatatttcaaaatatgtttgtatgaaaacatcacaatacaaaccattttatatatcattaataaaagtaaatacaagtagaaatttgctatatatcctaaagaagttattaatatgagaagagataaaaatgattttcataggttaaaatacttctaagacccatcatatactttctgagtgaatggcatctcttgtgtgtcagcagtcagactttgactcttttttttaagatgctcacaattacatgctgctctttatctttttttgtggagtgggctcccaaagtccatttgtatgctaggatccactaccagaggccccacaggtgcccaaggcctcctcactgacccccacattcatggggtctgcatcagttctatgctggtttcccagctatcagtctggggtccatgagcttccccttgttcaggtcagctgcttctatgggtttctccagcctgatcttgacccctttgctcatcactcctccctcacagcaactggattccaggagatcggctcagtgtttagctgtgggtacctgcttcttccatcagctactggatgaaggttctaggatggcatataaggtagtcatcaatctcattatcagggaagggcatttaaggtagcctctccactattgcttagattgttagttggggtcctccttacagatctctggacatatagacattcaagttatatttaatttttcacattttcttgagaatcttttttaaaataaaattatgtgtgggtactacattacaatcattcccagcctttcttgttgccttttccctctcattttttctttaaaaactgcttatacacacacgtacacacacacacacacacacacacacacacacacacacacacacacacacactctgtataacatgcttagatgatttaaggttgctcatacgtatatgtttttagtgcagataactggtattagataaccaattaggagcctagatttgaagaaaactgagtctcagcagtcaataatttcctgtaggtcttcatctagggtttatccttatgatatttatctagtccacattggaatatcaacctggtattgccaatttttagttagtctttatgtagccatagggttaagagtctgtgagtgcagcttccatattatatgcagatctcacaggttatgttgtggttttctggctcttgcaatatttctacctgttcttctttggttttccccttagtcttagatcctggatttcttcttcttcattaaggtgttttgtgaaagtattttatgacagcaacatgaaggaaacttgctattatgaatgtcttctaaattatgtttactgtactaatgcgctgagatagtagaaaagttgatgtttgtttacctttataggagatgaagctataatacagacagtcagctattttggtagcttcattattagctcccagttcttaaaaactgtcaatctacctaaaattaatatttcttttaccattctattctttttctaattttagaagtataacaacatagatcacaaatcttcacagaactgaatatttgatgagaatgcattgcagataaatgaaaataaaaaatatctcttctggtgaaatgtgtattgaccaacctaaggtttttccagtggtcattgttgcttggggtgcatgttgttctcagagacttgatctctcatccagagctttgatcttcttggttgagtagtatgtttttatgcattatgtcctcattacagaaaacactcttgcacatcagaaaagcagcccagtgacaagtccgcctttcttttggtgattgttccatatggctgggactgaaaagactcaaatgtgttcctcattgcatgcacatttcacagtaaaactgccactagctgacattctgattttaaagatattagatttttatgtgtcctaatttttatctaatgttcacactgaaatgttcttgtgtttatataatttactgtgtctagttaagcaaaagagagctgtattggccacatcagaagggctggtcctacctatcttgaccatcatagtagaggtttatttaaagctttgtttccttttgtgttgcctatggctgtaaaaaggcatgaacattaatcatgacattgactaatggctttgcctgcttcatgatgtggagtagccatcatgactgtatcatttgatagaacttttatctggactggttgccttaataattgaaagaaaaactttgtcttagcatgatatgtgcaaattaaaacagattacaaaactctcccttttaggaagctgataagttccttgttcaatagttacaaaatagaagaagaaagataaggaggaggaggaggaggaggaggaggaggaggagaagacgaagaagaagaagaagaagaagaagaagaagaagaagaagaagaagaagaagaagaagaagaagaagaagaaataacaacagtgattgacatattgtagaacacctgaatttattcctccctgatttctctctggcacagaataaaggttctggtgtctataggggttaacaagttgtttgaaagacattaaaagatttatcaacaaattaagcagttctctgtatatagtggtaaatgataaatgacaactgaggtatatgttcaaattaaagtatttaaaaaggagttaggcctggagctatggcctagcagttaagggcacttattcttgtagaggttctctaagttcagctcccagaactcagattggacaactcacaactgcctgtaacaatagttctaaatgatccaacaccttttcctggtcttagtggatagttagaaatcatgagccaactctaggaagtcttccagagtggtttcataggttttcttttgtgtttcaggtaacaacacttgtcaatacaagcaacaaaggtccatcaggtaaaaagaaaggaaggtcaaagaaagcccatgtgctggctgcatccgtagaacaagctactcagaacttcctggaaaagggtgaacagattgctaaggagagtcaagacctcaaagaagagttggtggcagctgtggaggatgtacggaagcaaggtaggtgaaatagcatgatgctgatgctgagggttgctgcatgaatgagataatattctttagactcaaaggaattgtttaccttgtttgctctctgcacatgatgtttgcaatatttgcatacttattttgatgttaaagtgtgggcatggcttcaaaccccatgcttttgccgttacttaaaaatcttcctattgcttgcccttggtgaatgaaaacaaattctcctatctaactcatatcttggtatgaagttggaagatacggtctttgtaaaatggcccaaaacccagtattttaaggaggatggaaagcaggatgcaaaaccaggtagaaaaaaatgttccatgtgattctctaataatctttttagtccacagcttttctcacacatctatatagttaacatagagtttatttggcatttgaacattttttcattagaaataaaatacaagtaacataaaattaacatcaaattgtttttaaggttcatgtacagtttagtgttggtaagcctaggcacatctttgagaaacttattactagacctttttcatcttagaaaagtaaaactgtatgcattcattcaactattcatatgctcttatcaaagtctctgtgacacactcttcatctatttgacaactgttgatatttcatagaagtgggatcctgtggtatgtctttttctgactggattatttcattaagtacaatgtcttcaaaaaccatacactctgtggcatatatcattattttagctttttattactaagcagtattccatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactattttgctcttgtgaacaaaattattattttattatacttaaataagtaagcacatatatgatggttaggtttaattgtcattttgaaacaacttaaaatcacccagacaaagagacttaagagattgcatatatttgatgctctgtaggggatcaccttaactaaattaatgggtgtggacaggccaagccttctgggggcaacaacattccctaggcagggcatcctgaactataccaaaaatagaaatgacattctatcttaccataatgtcaattaatagttcagaagcatatgccgaaatatttgttgaacactgatgtgtaatatctaaaggaatgtttcattaaatacttaatgaatgaatggtccatttatattctttgtgctatcttactgtcttttgcagttaatggatggatgtttagcatcttaaattaaaaccctttcacacaaacacaaattttctccatttcttgtgaatatggcatacagatgtgtgtacacattctttgccgctgtgtgggcacacgtgcacttcatacctatgttttgggggcacaaatttgatgtgggaatcatcctgtattgatttttccaatttcccaatgagacaggatctctcaatgaaacttggcctgtgttgatataaccagcctttcttatcagcttactctgtggaacccttgtctccaaattctaaggctgtaattacagacaggctaccacactcatccaaaatttacctgggtttctggagattataattctagtcctcacaattttgtggtaagagctataaccgctacagtgtcttccaagttcctgaccaatgccaccattctattgccttcctcctaaaagttaacttcatgtttatgacactgacccaaattgttacttctactggacatatgtattgttccatatttcaccttatgtgaagagagcatgagtgtatatgtgtcccgaaagtatgaatgcctccatgtctaaaaccacactaggaagctggtgtttttctggaagtatggtcagacacccgcttgccttcatgcatctgtgctctagataattactatttgctgttgatttcttatgtatactaatgtgcacaagtaaaaaatgcaaggtgtgctcagtttgacaactgtttgcaactgtgaagtactcagtgttctcaaggttctacacatatttacagtgaagagttttggtctctctacctccttaagcatctgtcttttttactaataaattttcctgtttagtttccatagcaatgccttaggtttctctctctctctctctctctctctctctngtttctctctctctctctctctctctctctctctctctctctctctctctctctctttctctctctctctttgttagttgcagtatttggatcttgatgcttggttgtcatgaggttcatatgaaattgtctattgtaactccaatagaataatcaattggctagatttccttggtggtatgagaatataagattcttatttaggactgcttacagtggttgctcttctgagaatagctgattactttgttacagaattgattcttatggataacatatctgaagaaaccctgagcccatattttccttttcctgaacagtgtcatattcaaacacactttactgtaacatgctaagtaacaaccaaagtattaaaaagcttgcttaaaactcccctttgcttttgtgtacttgcttcccatctgtcagagtgtgcctctttccaggcaatgtagtccattactgtgcctgcagattttcttgcttcctttctccctttccccaatgacagttcagctctttcttcactgtgtgatttcctttgcccatctggcttctgtcagttttcatattggctctttattccatctttttgcacaatgtatagcctgagctgattttcagagtgataaaaatgaatgaacccatgagaaaaaggtgtggatgaggttgggaatatttagttatttgacatctaaaatacagcagcatacctcccattgtagaaatatatatgtctttaataacatagaagataaaatttatgtgaccatttacatttggaggtaatagtttcttttttcaattttttcttcaatgtccatgtatgtatactattttattttctctggcattgagattgattctaaggtttttcccaaactagacaagtgatttacctctgactttcagttctcagtcttgattttgtgttctcagataaaatcttcaaagcattttcaccttttttttccagaatgaagagaagagctttacatggccatttttagatttctggtattgagtcatttaattttgttcatttatagcttctgggtgtttgtggttttaattatttaatctaataaatttatatgcaaaattatgcatttaaagtatttactgcctcttaacatggttaaatttactgttgtctcaatttatttattacctcttcaaaaattattatcttctcaaatctaggatgcatgcctgatgttcaaaagtatccataatgcatgctaactatcatttaaccatagggtattctgcaagaaaagcgtactttcaaattacaatctgtagcgtgttctttgaaaaaggctatgatagtgtatacatgaggaacatgtatcaaaaatgcattttcaaaattcatattatattcctgtattcaaaacctggaattctgctgacttatgcttggatgaagataacatttccaagtgtgtgtgtgtgtgcgtgcgtgcgtgcatgtgtcaactatctgacttttatcttaaataaaatacttgagttaagtgtatcagctaggtttgaatttcatcagcctaaagacagtgattattactacactgtcttatctagataggagcttgatactttaacacacagtgagtgatggcaaggacagaggctgtcttggttaccattcaagtgttgtgacaaaacacataacaagtttcctataaaagaaagtatttaatttggggtccatggtgcagagggttagtccatgaccatcattggtggcaagcatgcgatcaatcaggaaggcttggtagctcaaagatgagtagatgagtagctcaaagttcacaatagacctagaagcacaactccgagagggacactgcgattggcatcagcttttgaatcctcaaaattcaccccagtgacatagcatctccaataacatcatactttctgattgtttttaaacaggtccaccagctagtgcattcaaatatgtgagccttcagcggccattctaattcaaacatacacagaggctttcctgggaaaccagtagatatgtagaggtgtggttaagatttcaaattttaatattactttggcaaaatacctaaatgttacagactaaaccacttaagtatgtttagaatctggattctccagttttcagatgcagagagagaccatgcttacattaggtggttgttttcactcaaagaagtcaaaggaattttaaaacttaggtgtctattggaggaaatgattcagcacatataaggtcttgccaccaggcctgggacccacatggtagatggagctccatgaccacagcttaataccctggtgtatgcttgcagatacacacttaaatgccacagtagatttataagttatattttgttgacttcacctgtatctttgggaattgctctcttactcgattttctttttggtgagccaatgaattcagttgtggttccttactggagaatgagtgagagcttatttgcagaagcataggcaacttaccaatggccacaccactaaataaaatgacttttcctctcccagtaaccactggcagctggtagacctcatttcctgtctaataactaacaagcctgaatcctctcaggcagactggtagcatccagtggtctttctgaagactggttgtgtcttcatgactcagagatggtgggagttgtgtgtagaccccgcatgctacaagagaatagatgtatatatgaagcacacatagcaaaacttttcaaaatcagagaaccaagacactgttataaaaatacctctacattgatgtgcccagaaagcttaaaactgatggagtgtttaccaccaagaccttttgaactgaaagtacatgtccaactcctgttagtatcagaatcatctggaaggattttaaaagcctgacatctatttcctgctatgattcctggagtatgacctgagcatggtgtttcaatctccaaactggatggctctgtagaaattatttctgaacaaatagactaagtttctgattctgcattatgtgcacatagatgctcgatggatcctgttagctggagatgcaggtgactgatgctaagtgtatgtgtttctcaacagtgcctgttttgtcttaaatatttcaataagtactcatcattttctcaagaaacgtttaaatatcaataatattttgccaagcttccaactttgtagtttatttagatataggtaaataaaccttatatgggaaaatcaacctgatactttacaataaatttaatggataggtaatgtcttatgatggaggccttcccaatcatgatgtactacagtctcttagaaaatatgtaataaggtatttagcaatcctgtctatgaggcagttaaatattaaaggagtttcaaagaaaagaatggtatactgctgatctcatttgatgagcagttttggatgcaggtgcaatttcagctatgctgagatggtggggagggtcaagactgaggaactttggcaactaagattattatacacaacataattgaaggaagagagagaggaagacagaagctgataagtagctgcttgttacctccataggggtatgctgaaagattaacctgccaagtgtggtggtttgaataagaatgacccacttaggctcatataccccctgaatgcttggggagtatctttaggtgatatggccttagtggagtaggtgtggccttattgagggaactgtgtcactgggagggagtaagctttgaggtttcataaactcaagccagtcccagtggaactcttcctactgcctatcattcaatgtggaactctcagctgcctctacagtgtcatgtctgcctgtgtgctgccatgcttcccttcaagattgactaaacctctgaactgtaagccagccctaatcaaatgttttcctttataatatttgccatgatcatggtgtatcttcatagcaatagaactttggccaataaaaagtttataaaaagttaagtgaatcagcatacacctggcgcagacatatgatttttgtgtagttaccacaggaaatgaagctaaacaaaagcacagtgctttcaggatccacgactgtggtggaagccacgggaagagaaacaaaaattgaatgttacaagcatttcagaaaggagtcaatacattcccatttattgaaaggaaatgagagtgaacatttgctcttgtgtggccacaggcaacatgattgggaagacttaaaggacagcaggaccagagttgaaaccagtttcatttaagacattgataaatgaggagctctccctagcagatggtgatgctgtagggatgggccactggtaaaacaaggagatttgcaagtatctgaagttgatgaatgaatatctcagagatgtaacattcctttgagtaagtgtactagataatgaagagggaagggatgactgtgcaatttgggaagaaagtccacatttggaattgagaattggatataaataaattagaacaggaagctgctatgaaatgtgaagataaacaatatagtcataaaatctgaagaaataggacttttaataaaggagctagtgatctatctgtacccctaggatgctgtcagcatgtcgaatttttcagatatgacagaccatgaacacttttgattttgcaagaaacgtgacatctattacatttaaaattgaattttcagaaaatggcaaaaacagtagtcaaaaagaaggcatgtggaggatatagaatatgatgcaggggagggagcctagccaaataaattagctgtaaccataaggaaccctgaaaacctgtaaaggaaggtactattgaccttaggtgcctgcatgtacatgcatgcaaatgcacatacatacacacatgtccacaccattcacaaatgaagtgccagagcagggagggagaagagaaggcctggggatagatgctcaaaagttagagtagatggtgtaataattgagctaggtaaaaaagataagtagacttgcctgtattgctcttgaactatttctatacttatttttgcccctgtagagagtttgggacagagctgattgactgtgtgctattttgtatcttttggggagaggaacacaatgcctttcacacaatggcatttaatagattcattgattgattaccaagggatggcaggaaagcaatagaagaataatggagaaacattaagagaaaacgttgagtataattgtttccttgtttatatcttatagcctaaatcaaagagagaggaaagccataactgcaaacataaagggaaagaactcaactggtagcaacataaagatgtcttcacagaaaaatcaaataaaaaggagagaccaagtctagagaggctgtgcagtagtcgagaggcaacttagtagatatccacagcacaaataaagctggacccagatggactgttctgtaatctcagagctcctgtgacaagatggtgagaagagacaggagaatccatggaagctcacagcctgctaggctgtgtaagtagtggtaaatatcaaaagagagaccctgtgtaaaataaggtagatggaaaagacccatacctgaggattgtctttgacttccacacataagcacacatcattgtgaactcatatgcaaatgtacacacagcacacatatacacaagtcttttatagaatagatgagttgtattcaccaggttaattatctaattctttttgaacaatgagagaagtggctttaataagctatggatacttgtttggagaggtttaatagatatgtttgttgttggcaaacaacaaactctcccatctgatttcatttcttagtttgctaaaaagaactgctttggacattgctcctttggacattgtagaaaatatcaatttataagaggtttaatcatcattgtctgagaacctattttctttgatatgtaacagcatttctagaactttcttacatttgaagcagactcaaaaactgtgctttgaatattaaaagtcatggttcttataattcttttcaatgtcaaattcaattggtggttcaacacagtctggttctatgcctcagcatttagaaaagtgtaaagaaccccccttggccttctattattacatctccacttcctctgaagccagggagtagtgtcctggatttctttccctcaattcacacctctgcattcttattaaccactctctgtttgggcaattacaaatcaaaagcattaagaaatttccctgacatcaatagaatatatatcaagacatatgtggctgggcccctgcattaatggtaaagtcttggttcaaaatgatagaggtgcaggtgaaaaaagtggtgtattctttcatggagccaatttgtaaaacaaggtgatggcacagcatttaattagtcttgccaaaacccgtggcttttctctagtttgacctaaactactaggtgaactgatagattgatgtcaaatagctgttttatttttacccattgaatacctatttaataactattatccagtgggtgaaatcacaggaagcaaaacagaggaagggagaaagaagcccttcataacctccagaagatatacaattgcctactcgtcacctgatgactgtctcacttcttgtttgataaaatcacccacgtggaaagagatggtggctgcaatttcttcatgggtgtctgatgaggctgtctcagaaatggtatattgccaagatgctgttcttctttcatgtgtcctttttctcttgtgtgttgagcttcaacttttcatactccggatgctggtgtgtgcttgctgacatgattgagtacccttgtaggtatagtgcatcttcatatgtctagagtgtgctcctcttgaagtggtgtgagattccctccttttctggatgggagtgcagattccattccacaaagttcatatctttgaacttagatttgctgcatgtaaatcagttattctgaataaaattagcttactcaaatagcatacaatgttttgagaaatctttgtgaaattggttatgaaatgctcagaaatgttcaagcctcttacatgaatagcacacacagtgctttacatacaacttgtgcatgtccctcttcaatgttcagatactttttatagcagtttggtgcccaatccaatgtaagccactgttaggctgtgttatttggggagaataatgatgataaagtagactatgcatgttcaatagaagtacaactaatctcaaatgattttcagtgttaaatctgcatattctaaagctttaaatatggagtatcaactttaatataggaaaatagccatgcataggagcctagggcagacattgaagctgagatggcatgtggctccttcttcaggttagacattgaacagagctgggatcttcagatgcaccactatagccatgcaaacctgaagctgcctctctgattacagactccttcccttgctcatagagtcatcttgttacagctgtttctctgtataaagttcacagacagagtgtttcagaataattgggatatgacagaaatgtgtataaaaactgagtctagagcttcaccatacttgggtttagaatgcatagacttccttatttctgggtggtgtctcaagtggattctaaggctccgccttttgacattaacaattgccagagcttaatgcatatctatgactgctaccttttgttcaagataatttaaaaattcacttatttttgttgtttagaattccatacatgaatatagtgtgttttgttcaaataccaccattaactaatatagatctttgtgtgtgtgtgtgtgtgtgtgtgtgtgtgtgtgtgtgtgtgtgtgtgtgtatctatgtcttgtatgtttgcaagtgtggatgttcatgtgtagggttgcacatatgtgcaggtacacacacacacacacacacacacacacacacacacacacacacacacacacgtgtgtgtgtgtgtgtgtgtttacaggccagaggtcaacctcaggtgttattccttagggtctgtccacctttatctttgcgaaaagttctctatttcctaggagctttctgatttggatagcctggatggcccggaaaccatttgcctgtcttggtttacccaccacagtgattttatgtgtgtaccaccactctcggttttttgtccttcactggggatgctggggtagaactcaggtccttatactacttgcatggcaaacactttccaagcccagtgtagcttttatttccttttaaagtgatgtaatcagggatggaggtaaagtgggagtttgagagtctagtgaaagtttcaaatgaatagaactgtgagctttagtctccagaacagtaaacaaagcaaagcaaagcaaaaataagtcaaaacctcagaaagaaaacaaatatcagcaacccaggctgctaccagatagggaaatcacttttcagaagcttttaacctcagaatttccaaaagaaacccgagtatgagtgcaatgttggacagataagaggaggatggatgtgaaagtatcatgaaagaaccatccctgtggaaatgccacatgtctttgaattcaccttaatgcaaatattaacattttctaggattttaactgctgcgtattttattaaataaaacactttgtatgtcacctttgacttagttcaggacccagatgtgttccaggtccacagagttcccttgttgtaagagagtttgagaaaactgtgattattctttcacttcttcctctttctgggacccttggcttttggaaaggctgcaatctttggctacaagccaaaaaagatgacaacattgactccttcttatttactgatgctccatttgtcagctgctgaatctgttttctcaacatcattttgctagccatcaggaggattacttgccatatttttttagtcagccactaaatatctatcagttattctgatagataacccgtgtataattgcccaaagcgtgtctaagtgttggattgttataagcactatcctgtgtgctgagaataaaaacacaacaacaacaaaaaaccaaacattctttgcctgtagcaattttgcactcagagttgagacatacaaattaataagaaaaattgtgtaggttagtgatttccaagtgtataattatggtttgagaaaaaaaaaaacttaagtggggcttactattaaaataaaaattaaaggagaagacaagatggctcagcagggactcttttaatggtggaaggagagagccaattgcacaaaactgcccacatactaagggcacttacacccccaagctcccattcgtacatcatgtacacacacaattataatatttttaaaaaggaaaaatctgtgctacatgatagaaaataaatttaatatataattaataaaagacacactctaagaggaaatatttgtattctacttctctggtgaaaggctttcacttgtaatacacaaagtactcttaaaatttaacaatgataaaaaacaacctaattcaaaaggtaattgaacaatttgaatagaaaccccattagagcagatgtgcagacaggaaataagcatagagaataacacttccattcttgtgactgaggaaagtgatgcaaacagtgagattttactttacaccttaagatctctgaaatgcgttgacacacatatggcagagccatggagtgaaagctaattcactccggtggtagtgagatgacataaccatgttttctttaatgtttactggcaggtttatgaaaaaaagaacatgatcatgaaagtggtacagccctggatattaacttcttgagttctaaatacttctgtacatgacagtacctatacatgtcccattttttctacaaaaatttttagaataattttacaattacagactttgcaaggacagtactaaaagttcctatatacttcacacccattttctgtattagtaatacctggcacccttgtggtttgtttgtcacaatttatgaatcagtatcagtgcctcaatacttgaactgagtgcagcaagaagagggagcacggtaacaaactttgggttgagatgcacaacacaagtggcaagaataaagcaaatactgatgagtttttattctgcagctgacttatttgagtgatgcatgatgaaaagtgatgaattagagatctgtatggatacaacacagagatctcatttagactaaccccggtagaggcctatttattctaagcctctttattcagataaaaaatgtcagtatgttatattgacatacacacaaaaaagtaaacatagaagtaagaacaaagtaagaacaaaaaatgatggaagtctgtggacagcagtagagaaaatcatggtccaagactgggttgtaccaggaaagtgcttgaggatcacacagatggtggaagacagttgttttctgcagagccatatatcctcagagtgtagcaacggaatgggcagctttgctgtgggcacattttcaagttccaggtctttcaatttccagtgtgcccaagctgtgtgatttggggatctggcttctctgagttagggttttcaggagctcattggcatgcccagtcttacatacaccctaatacactaggtgaagagtagcagaatggatcttagaatactgcagtgtggagacatccagtggcggggtccttacctgaaaatttaattctggccgctgctctttctgcaggattgcttgtaaagcttgttcatgataaaatacttcagtatctcaggtagaacactcactcaatttattttcatttgaatctcttcttttaaatgtaggttgttgtttgttttgtttctgtagtgctaggaattgaacctggagcctgatgaatgctaggcaaacactcccacagacttctttctcccaaacacttttactccatctgcaattccccttatttgaaggaacgtctttaagttgaccatctgatcccaggatacataaaagaaagcaacctgcattagcacaaaaagaaatttggtcatcaagggctttctgagtaagctcagcctgtaattcaatcaaacaatgcatttgccagagcattgtgactaacggggatgcggtttccaagataaagccggctcactcatgcttccctaattatgatctatgccagtgacttgatataagccagactgtcttcattagctcccccctctgaaagggagacttcagtgagcatgcttctaaattagactgcttttagtaagaaaataaatgacacagggaaaaacatactcctcaatccattctgtgttctgctaagtgcttgttaatgcaaagtccccaaggacccccagtgtggatagacatagagtcaatacaataatttatggagaagccaccccagctttgcagggctggggaggagtctctgtcttcagaagctgatcctgggcttccagataaaatagataagaaatgggtaggatggagttggaagggaagctcacctccttttgatggtcctggcaatatatgcttattttcctgttccctcagttaaacagaataaaagaatgttgtatctcccagttgacagacctcatagagggacttttggcattttcctataccgtgctttcgagaactctatttagatgataaccttagtctcaaatttccagtgctttcattgctactggagcagtgcagaaagcacacagttatgttgtatgtgaaggcatatggaaacccttgcctaactcatgtactggtattataggcatgcagtgcctctactggcttctatacatgggcactccaggtctaattcagttatgcatgcttagttagcaagtgttttactgactgagctaccttcaaagctccttcactgcctttgaagaatatttattgtatttttaatttgagtatgtttgtgtgactctgtgcagatgttaatatgggttcaggtacctgtggaagccagaaaagggcatcatatcttctggaatggagttacaggggattgtgaaccatttgaactgggtgctggaaatggaattcagctcctgtgcaggatcaggaagaattcttttttattattacttttattttgcattctaaccacagttttccctaccacatgtccttctgccccccttcacctcctccaacccctcctcacctctcccacagcccacccccagtctactgctcctcacctaagggctcccatgaggagtcagcatagtctggcacaatcggttggggcaggggcatgctcctcttccatgcatcaaggctgagcatggcatcccaacatagggagtaggctccaactagctagctcatgtaccagtttctatcatagtcctactgctagggagccctcatctagtcaaagcttgacaaccatctcccacatacagatggcctagttcaatcccttggagtgtccacagatgtaagtctagattcatgagtttccatgagcttggttcagctgtctctgtagatttctccatcatagtcttgacctcccttgttcgtctattccttcttccttcttccttctcttcaactggattgtgaacacatgatttttgacaaagaaaaaaatagcacaatggaaaaaggaaaacatctttaacaaatggtgctgacataactggatgtcaacatgcagaacattacaaatattttcatatctattgccatgcacaaaactcaaatccaggtggatcaaggacctcaacataaatccaggtacattgaacctgatagaaggtgggaagtagcgtgacatgcattggaacaggagaccacttcctaaatataataccaatagatagaatctgagagcaacaatcaataaatgggacctcctgaaactgaaaagcttctgtaaggcaaaggacactatcagtaagacaaaatgacatcccacagaaggggaaaatgtcttcaccaactccacatctgacagaaggctggtctccaatatatatccagttgcagagaaggaggagtgatgagcaaaggggtcaaaacctggctggtgaaacccacagaaacagctgacctgaacaagggagagctcatggtccccagactaatagctgggaaactagtatgggactgatccagacacccatgaccatgggtgtcagtgaagaggcctcggaaatctatagggcctcttgtagtaatcagtacttatcccaagcataggaaaggactttggaagcccattccacatagagtttcctcagcctagacacatgggggagggcctaggccctatcctaacggatatgaaggattattaagaacccccatggaaggccacacactccctggggagcagaaatggtatgggataagtagggtgttatttgggggtaggggagggagagagaactggggttgacatgtaaaacaatcttgtttctaatttaaataaaaaatgggacaaaaagaactcaagaaagtagatatcaaaatacaaaataacccaattaaaatacagggtacagatctaaacagagaattctcaccagaagaatctcaaatggccaaaagacatttaaggaagtgctcagcatccttagtcatcagggaaatgccaatcaaaaccacacagataccatcttacttctgttagaatggctaagaccagaaatactaagggcagcttatgttggagaggctgtggagttaggggaacattactccattgatggtggaagtgcaaatttatacagccattttggaaatcaatatgaaaattgggaatcaatccttaagacgcagagataccaaaagatgctcaagtataccaaaaggacacttgctcaacgatgttcatgcccatctttttaaagcctaaaaaaacagtaatattgctatttaaaaaaaacaaagcatgttctgaattagattgtgctgctgtttgttgctctgtgtgccgattctattgtagagctccattatggattcttagaggagtatttatgggatgaaaggccagaagtattaaatatttacatccattagaatgtgatcttttggtataggcagaagggagaagaattacttggtttatttccattcacaggctttatgaacttactgcttgggtaatttcttaaatgtcacaattaaaaatattgacctatttctctatgggctttcattgaaatggtagcagtcatctctaatgttacctaataaatttaaaagatggtctttaaattgaaacatatcatcactagaatttccccttttcaatcccagggctctaaatagccaggaatgctcttcttcatagattaacatcctgagagctacaacatgaacatgatgtctttgtcttcttcagtagagatagacagagcagagcatgcactgtgttgtgcttttctgaaacagcatccttttacctctgcttttaaattctcatctaagaaatattttaattgttctctaatatgtctttaaatttttctctggtgtgtgtgtgtatgtgtgtgtgtgtgtgtgtgtgtgtgtgtgtgtgtgtgtttcaagacgaagagggcaagtgggttgcccatataaatacaaaggccagaatacattctcagttgtcatccctcagaagatatctatcttccttcttttagacaggtcgtctcactgacctgaaactcattgaacaagctgagctggctattcagagagtcctagaaatttgcttgtgtctaccacatcagtgctttgatatttgtggttttgtgcagagtctagaattaaactctgatccttgtgtgtgcaaggcaaaaattgtcctgactgagccatcttttcagttcaccatttttactcttaaaaatctgcaatccagttgatcaatgtcctatataagtgtttgttcatatagtggtagaaggtagagttgtcatattaatattgtgtaaatcacgtggtcatccagggtgtatctccatggaatcagaaggatgaaagttagcaattggctggggcaaggcttttgtagcccttatagaggggttgcccatggttcagaaccaccacacttgcccctgcttcctcagcaagtgagtcaaaagagtataatgagcctttgtaggacatgagtccccaaaagataaccaagatgtgagggacccttagctaccatgagaagccagtagatgggtcagaatgtctcagtgagtccagttttagcatgggggagactgggtttaattacttaaattgtctaatcttcatccagagacatattctgtaaggatatacactgcagccacatttctggtgattctcagctaggacagaagctctagaccagtcattccagggacactggatgctttcttaatgtaatatggtaggaaagccattcattctgatgttagaagtggctggctacaggaaactatgtataacctatctctctagtttgatgggtttatctgtggattatgtaaaatgggtagtacaatagtccctgtattccaaaacaggaggaacccatccaacatgacctttgatggagaggattttgccagggctatggatttggagaagtccttcactgctgttagacatactgattgacagaagactaaatcttaagacagggtctctttgtggctcctcattttacaatattagagacaccatctattagttgttgacatatactttgagtctcaggagagaattcagcaaggttatgtggtccataataggaagtcctgttatctgaatcaactacaaacattttgtgtcatgagaagccctggtatcccaatcgattacaaatattttgtgacaaaaagaatcttagaattgactggtagccagattcatgtgattttcatctggtaggaggtcaggggcaggaatgtcatcctcttccacatgggatcaacagatgccagaaccattctcagagtgagatttgcaactttcatgactatgcagaaagtatctgctgatctattaaaagcccaacacaaggggatcctccaaagaataattttatctattgtggagtaacagaatattgtaatgggaatatgagagccctaataaaatgtgggtgtagtcaaagtgattaaggtgaggagatgctccaaaagacaaaaatgactacggctggtatttaaatcacaagattggcatcaatgaagtttattggactagtgctaggctttgatttgcttagtttgttggtttatttggatatgttttattttgattttggtatagttagtgttgatagtgaatccttttctaattctgataatgtacacatttctttcacaatccaaaatgtcatctgcatgtctgtaggagacatctatgctgcaacacttacagattgacgttttctgctttcagtgtgcttaatgaaaagaaacagtcttctgcccttacccttctatcatttatatacttttcagatcattcactggtttccaaatctagacatgtacatgtcaagctgccccacagacactgtccaatgcttagtatccaggattattggtgacccagaatgccagctgtattacaccccagctgggatctcaaaggtgtctgtttggcttgacctccagtaaatagtgaatgtgtaaaagcaaaagttcttctgcagaaaattctggttatcatcaaatgggcataaatagaagtttcagattgctgttttcagtctctgcccctgtctctgggtgatgcatacctggggtaactatctctaaaagtgatggaaatgaaaagataagagcaactcagtctgtgaccctgcctccttgatagtctctcactataagttctgacctttcctcaagacctaaacaattcctgatgtttcccatcttatcttagttctctaaatacagtaacactaaaagaaatattttgttgttatctagtttttaaaatgagttgcttcacctacaaaataaaattttaaaaagcagagttaagacaatttgttcagccctgtggatgaatagtttttaattatcaatcagaacacagtttggcccctgaaaagttttcattctcattgtaaactaaagatactggggaaaacactggaacagctgtcagtcaacacaagggtatcttcaaaacaggagcagttccctctggaaaagctttctcaactttttatattaacattgagaacacactatcatgttatttactagtctcagtctgatgacagtatgtggataacacatgatttttattagttttctttgcaattctgagagaaatacccttttttatgaaacaagttgtggattaaagatgaaaatttatcaagcatgggccttaaagataacgatgaaaagttataaagcacagcttgaagggcaatgtgctcacttctttcatttttccagcaggatgtagttaaaattggcattttccacattcgtcgtctaggtttgtaatgccgagattgaaataaatgtcatcaccagagcactagaaaaccctcctctcttttgttctatcatgtggggctgtcacaaaaaattacatactctgaaattagcaggtattttttaaagtttagtaatgattctcaatattcattgttcaaatggcaagtactaatagcattttatgttgccttctctaaatttgaaatgagtgtctcctatctgaagaatagcaacatacattacaggtgtcttcagggataaggataaacattttatgattagataataattaattagatgtatcagaactcatatgtttgtgtcccagttattttgggttcttatgtctttcttttatatgcagatgtttagaggttacccagctgtttttcacattttggtgattaacagtaaacattataattcggtcccttccagttttctacttgctatttatcaagtctttatgtagtatttcagactttaaagaatcactgatttgcatttctctctgtaaagatgaagttataagctccacctggctttccaggtataaaatgagatcgatgtggtcatatatctttcctattttgctgaataattcatctttatgttcttcttgcacagaccctgatatttttctttcatgaggcagcaattggtttggatttactgcatactttcattccagcccctttctctgcagcttttcttctattgccttttccatccagaaaaataacactttgggtgcttatgagttgtgtgaccattttttttttaccctaactatcaatattgtcatttcatatcccatctctctctcttttatctcagagggcattggaagagaaaaggtaggttagacataaaaaacattacttttattttcatatccttttctaaaatctctaggtagtaagattattcttatctctgcattagtcatcttcacacttaatgccatctaactattccatctatcagctttgtaagaaactcacagccatagtcatatgaattttatcagaaaatgaattggaaggtggtcctgtgtgctaaagttctgaattgaaagaatctgcctcttataaatgtctgaggccatggtggtatatagcaggtgacaacttgtgctcagatgtcaacccaccagaggaatgattttctgatggaggaaaatcctgttcaggaaaggcttgcaggaccaccaactctgtaaagtgtagctcctgtctgtaatttcaaatgtgcaaaagcagctatggtgtctctccaattcctgcactttagtgtgtaatctcataagatatggatatgcaatctcatgacttcatctcagtcttatgggcacatatatctgtggataggcaggaggatgacttctcattaattgtataagtttggtaaacagaacatatattaggatatgcttcataactaaatttattgttccacaaggacgacaagacatttaaaagcctggattgttccttttattcagaaaacaataatttctccctagtctaagacaaactacacacagttaactcattttcaccttagagcaagttgaaactagacttaatgtttctgtaaatggatcataagttaagaactttacagatatgcacaagggcaaagtcacagatgtctaatcaaggttattaacacaaagaatcctaaaatactatgccaatttctttaactaaacttggctgataacacaggccaatgcccacttcctactaaatttcatggtaatttgcactttacacgaatttctaatctcagtttatgatattaaactcaaggttcaactaactaactgtttattgtttgggtcccagataacaattaatcaattaaccaagtccaaagaaaattaatctgtgtccagctactgtgggtcatttcacattagccagggcttcaaaggatggtctgtccttacaaccaaagttacaagatatccccacttttatgttgtggggctacaaacaagataagaggatgttgggtttggacgtgttcaatgccactgtccaggaaggtgccaagcagcatgttcctgcctgtgtgttaccatggtaaatggctctattccttattgcttcctcaggaatgtactttgaccatgagatgcaactctttttttccattcatttatttagctcataaataaagtcatgcacaattatgatacacaatatagtatgttcacaatggcatggctaaattaaaccaattaacatgttatatcacacatattcatcatatttgttttgagaacacttaaagtatactatctcacaacttttaaaatatagcatattgttatcaaccatatttatcatgctctcagtagacctcaagacttcagagagtccatgcctcttgtccaactgcagttttatatccttaaaccaatcatttcccaattgttaaaagacccacattgaagcctaactcttatagtctttttttcttattgcctcaaaccatctgtaaaaaatgtatttaagctaggtgaacaaagaagcaagggagaaattgaaagagagaattggaactaaagataattagagacaatcatagcacaggaattatagctgcagaaaaataaagaaaatgaccctggaatcatatatgtaagtctttatccctcagctaaaaaactgtcaagttcagttttgctacgctgtggaccttcaaaacctattctctttggctacaataaagaaattgttcactagatttcacagctcattcaagaaaaatggggccacactgtaacaatccactcttggtattatttaatctgagtaccaaatccatgtgacccatgctgtaaaagtctgggtcagctctgtggtacatgcaactttttaggaattgggctaaatgaacaagtcactctttgcctccactctcttggtgaggactgggaaaagtggctcaaggacaaatggacccatgacctctctgaagagacacatttgtatgggaagcttgtgtcttatgctgtcttagaggaagaggagtaggaagggaccttgtgactttctgcactaattcacacattactgcatggaaaggaaaacttggggattattttttaaaggaaacaattaatggaacaacttagggcccatttaaggtagcaatatctggaaattacctttgatttagtaatcaagagttaattttaaaggatattatctcccaaatttaaagataatgcagtagttttattttacttataaatcaacagtatttttattattttaaaacctttaagctacatccaaaatattagtaatcaactatcattcaaccaataaattatgtatttatattagcagtaggagggtacagaggtttctaatacatataagtacataggtcatactctagtaaggtgaagaatagggaaaaatggtgttggaaaactatgtccaatgaagggatacacaaaagatgaaactcttaatgaagcatctggagaaaaataatttataataaaaatgcatagtaagaactaaaaaatttacagtgtatggcaagctctaccatcaaaacatttttgttttccttctccattgatatatgatccattctccagccttctctgccattgggtaagcccctggacataaaatttggcatattacaacttcttacttccctgtggaatgatgtagataacttgtggaaacctaaaatggcaaaagacatgaagtcagttgctgccttgtctctttaccttcacatttgtccctctttacattctgacaagaagaaataaactattttgctagctgactggggtattgtgctgtatcttgaccttttccccagtgaacattaaaatcacaaaattacatctgtgtgggaagcagatgaagtcttgagtgaatatctattgttgtcatgggcacagtcatgtcaaggagcccattgcctcagaaccatgggagtagcaaagccttccccgggtgagactcacggaaatgctaatgcctttttttgtccaagtatgattgtttatagaggatggaccagtgtgtgcaggcctattggtcacagattcctcctccatgactatagtctgagagtgctcacatacagagacctcctagagagattagataaacctgcctccctattcattagatgtttaaaaattaatatgctgaggttctcgacttgtggcctccatcacagtgagcacacaccaactgatgccagcctttatatacatatgcatgtgtgtatccttttcttgttgcaccagttaggtcagcccttgaaaacttctttaacccttatactaaaatcagaatgtggttccaggaatgtgaactcccattgagttctcagtctaatagggagggagtatatataggcttccatgctagctaccaagctgggaagagatgtggaccaaagcctgagatggggacagggcttgattgcttaatgtgctgtgggaaactatgttttaaagctaatagagataagagctaagttctggtagggatcagaaagcaaattaaagcttgggggtcagagttaacttccttttgttatccctcattaaaaacacccagtatgactttagtttatctttacaaacatctttctgtatactgtagttaagatgaaagaggtagtgttagacccccgaaaactcaagtatccggggtctcaggccaggttcgcggtcaccccaatcaccaggcggattcgagagcttgctgcaaactacacgaggctttaatgtaatttaacgagctaaccccatgttagctcgggtctttcacccacccaccatggcggacagctagaaagacggctcctacgggctcccaaaagatcttatagggcagcgtaaggggagtgtctaggggtacgcacaggcttacacaggctcatgattggtgtgcttccaggcttagagggcttgccctgtgttgattggtcaactggttgttatggctcataggccctcccagggtggttgctatgctctctacgtcattgtcgtgtgcttgtccgtaaagcacacccagggtcgtaaagcatagcgccaccagctaacttctgattggttccttgtcacaagacaggcatctgacytctamktgaccaaggcaggtwtatggcaagcacrtgttcggctrttatggctkccaaaagggaagccggttccttcagtaggatatgtgaaagaaccaattggatgctcatgtgctcatttagagatggtaccccattgtttcccatattagcaccaatgttcctcctgggcagcatgtttctgtcatcaagaaatgaatctgtttcccttccccctgagtctggatatgcaaaaccacctatagacccactcaagggttttaatcaaggtctgaagccaccttttttgttactgttctgctatatgtgaggcatgaagaaccaacccaaaaaattaaagaagtggggattttctaagtcaccccagccagagccaacaccagcataattgctaaccatgagtgaggccatgtgcatctgtttgacacttagaaaggacaggatgtgtctgagtaagttcactgtaacttctcctcttactattttctctgatgctgtttcaagctctgaaatttgtgagcatgtttgttgctaatgatggtagttggttcattagttagttacttacataaatgtggttttgagataaatttggatacttgacacaggatctgtctcaagaatccaaagcttatctaaaactgacattatgaccaaggatggtcttgagtttctaatcttcttgtctttgtattttgagtgccagaactacaggtatataccaccttgtctttttagtactggagattgaacccagtctcaattctaggcaagtactctcacaactgagctccatcctcaccctgttttttttttattttagttcagcaagaattaattgttatacctttttgccattgcagcctagggatggagtaacagaggaatatggctatgcctcaggtaataatacatatttatggagttgtcaaagtctttcttagtgagagaattttaagaaatattatgagaaggtaaggtgacaaacagaaaatcaaatggtaggaccatctgtatatttcaattttgcatatacacaatagagaactagtaaattaatttttcaaaggaagaaaaaaagaaaacccttcactatattaaagctttatctcaagtatataattccgtgtctttctctctaatagatcccatttaataaccaagggggcagattctcaagccttagtggagtgggaattattttttttcttttacttggacatgtgtaacattagaagatgaagttgccttacctgctgggttgcatcaatgacattgcaggtcaagcttatctctaatgaatatttcatagccatccactggtgactatatcttcagtgctcctggacttatctggctcgaaatctgcttgggaaggcacagcagctactacaaatgggcagtgttgagtttccctcatttggagtgcctgatatggtgtgcctgatatggcgtggagggcagttagacagaggtttttatataaaacgtctgaagccctaagatttgttaggttctgatttcaagattctgcactttggttgtagtgtgtctgtagaacatgcagttatgtgtccatttcaaattttcttttttgattacattttcttacttattttgagcatgtgtagtgtgtgtgtgtgtgtgtgtgtgtgtgtgtgtgtgtgwgagagagagagagagagagagagagagagagagagagagagagagagagagagaagtcaaaggacaaatacgtgagtttcaccatgcacatcttaggtattatgctcaggtttattgggcttgttggcaggcacatttacccactgagtcatctcactgatgttgtttgtaatgttttcatagccatgatgtcattgtatagaaatctacttggagtgtttgttacattttggcattaccagcattggagttccataaaaaagataatcttcaactcaaagtgtgaaagtacagaagcttacagagtttggggaactaaagaggacataactaaattctcacatttaaaaatagtgagcatggagactggagagatggcttgtgattaagagtatgtgctgttcttgcaaaagattatagagtttggttccaataatccatgttaagcagctcacaaccatgtttactccatctctatagaatctgatgttctcttctggcttctacctacctgcacacacatagacacataatcaaaaataatacaagttctttaaaatataatgaacacagagaccctcagaaagcaagttgtgagggacagtgtgtacagaaagcttggatatgaggttattttcaaggcttgcgaataaataaaagtgctgtttctactgttcttttgtttgcttttatgtaaaatgcaattgctgtcatgtccctgccaccagtgttaagtgtcagtccagaagatcaggaataactttctttttcactgtggctcccaaagtttctagagaagtatagtcaattctgtcctgtactaagaagactaataaaaggtcaagaagggtgtggggtgagagggaactcattaaagtagacatctgcccattatttattaacactaattagaccaatgccctgcaattatattcttctaaattctactccagaagaggggaatggggttctaaataagtgtttatttgaacagaaaattattctacttagactaaagaagatcaatacacttccacttacctgaagtttctaagtgtggtatcttcaaataactgaccatcctatagttgtttttacctattaactgactttgtggaaccaaccatgccctctaccaggttacttaagggctggtgcaagacttctgtttggattgatgcatatatttctgaatttatggattagctgagttcttaaaaaatcctcctaatcttataaattcttgggaattttaaataatgaataatgagtatccaagttagaaaagtaaatagaagatgtatagttggaaattcttctctatctcgtctggtcccactgggtaggtttctctcccacccatcaggtccccacagtcacttatggaataacattctggggcttaatatcaattataattgtttggccaatgacttagacatattactggctagcactctcttataaatgaacccatttctattaatctgtgtattgccatgaggctgtagcttactggtaatattctggcatgttactcctttggtagctatacagcatctcctcaactcctccctctttctctccataactttgcttggatttcccacctagctttactttgtctggtcattggtcaaaacagctttattcatcaaccaataaaagcaacacatatttgcagcatacagaatgatatcccatatcagagatgtactatttttcttggcaaaatggtatggacaacaccaaaactatttccacggcaatgggtacaaaacagctttgtagtgattaagggctttcagagttacattgttctaaaagctacctggaaattctaagtgaagtgaagtgaagtgcataataatcagggataaatcatcatataagacaaataaaatcacgtaggcaactaagagtcagtaaagccattaacaactcagttggaagagaaacattatccaatatatcttttcactcaggaatttaaatctacacaacatagcataattacccaatcccagctaaatatctcactgtttcttctttgccagtcatatttcaaaggcactgagatggtggcatcccatttttgtagtagtatcatatactttttaattgagagcagatggctggattatactctatagataatatatttcctgattatgcatcctaggagattaaaaaaaaagcttaatctccaacccttttccttacttgaggcaaaggcacatggggtttgttaaggagattagtcacatcggtgcaattttaattctccccccaccccgaggattgtattttctgttgttagctctatataaataatgaaaattctccttggggttaactcagaggttgatctctgcaggttggcctgactcgctatgtgaaacctctagctagggttgagcatgccttcgaaccaaatctctttttcacagtgacatgtgccactcagataagacatagacagggttgtgtttttgtgaatgtgtatgtgtgtatgtatgtgtgtgctcataaccgggctatctcagtactaacaaaactacttctgtgaagagatggcaataatgaaatgtttgtaggactggaaggaaaaatgtttttattgtgtagatgcttatataccacaaccactcccaaaggtaaaaatcatttttatcttcaaatgtaataacacacaaagcacatgcaaaccagatgagaaggaagtgtagaattgtgagttagtggagggcacattggaatctgaaaacagctgagctctgtgtgccatacctgggaactgatgtcctgtgagaatataacccagtaacttctctatagaagatgagcctatgagtaccagactcttaacctatgctaggcaccatgtgtgtttggtgaggggtgtgcttttatttattttctctatatttattttctctttataaatgacttatacttgactcactgcggggagagtaggagaattggcacagtggttaaaaacgcatatttgtctcatagagaacttaagctggggttccagaattcaggtcagacatcttacaattgcctgtaactttagttctactgaatacaatgccatttttgcctctacaagcacctgcatacacacacacacacacacacaaatacacaaatacacaataaaattaaacctttccttaaaaaatgaacaaacaagggcacagagaaacagtgacttgccatggccacatgctaataataactaacacaaggattccttttgaaaggggaagacccaccaagtcgtaacgttgatctttgtacagtatagtggttgcctcaacccttagctaggaagattgcttgttggcccagtcaaaaatgcaggtatataactcatgttcccaaactacagtaaaaggaaagaaccagaactattatgtgagtcctgagatgctaacctgatgtctcccactaaagtgaatttaaggagtatgccttcctttctaactcaccgcactactctagttgaagtgatgtcctaatagacaactctgcaaagtggaaatgtcctggtggccaaaccctcagaattacaggctcattccatttgtgtgcatgcttttccagaaacaagattaaaagtcagcaatttctttaaacctcaagtgagccaagaagcctgtggttactgctctgtatgaaccagaacaacgtgtgccatccttcccactgtggcttttcaaaaatcaatttgcattgtatttcatccctaaatgcttttgttgagagtattctagtatttctaatgtaatctctcagtataactataacattcctaaatattcagatgttatgtcagtctagaattcccgaggaaaacattttacttggtaacgaatatgtgtgtgtttactatataggcacagatatatctaataccttgaatttacatgaattatataattattgcacttcatccttgtatagtcactttgccactcaaataagacatagataaagttgtattttgataggtgtatgtgtatatgtgaaattacaactgagctatctcagtactagcaaattacacttctgtaaggatatataaataatgtaatgtttacagtagtgtagggatagatgagattacaatatgctacaaccacttataaagatataaagcattcttagcttaaggtactataaaaacaagtggtaattgggatttgccccactggccacatagttggatgtttaattccagcacaggctgctatgttgagataggaatttataatagcctgcatttcactttgtgcatatgtgggtgtgaaatatgtctgaaattatagtttcatttgtttgaattatcatttgaatggcttttccagagtaaggaaatgatcttgcacttgtgttggttctttgggaagaaaattctcaaatgactttgatgatgtgtgggataaatgggagtctctggtggtgtgtaagactgataactaattggggttttgcaagggcccatttcccttggcagtttctaccaggaagagatagtgaaggctggactgagctaacataccaccagcataagtaaacattgagaggggcagatggccaagaccaatcaggagtctaccaacagcttatgagagatatgatcttgttaaactcaatcattttgtcctcaattctttattaattacttcctgtgtgattcatttctacatggtgtcactccttttatatcctataaaccacggtgttattctacacactgaaatttagatagtcatttttgtggcaggaagttctaatacattggatttgtctgaagcctccaagtacatctgcaattatcttgggtgtgctgtctaaagagaactatgaccaaatgatagtcatgcagtgatgcttagttaaactatgtgtataatttacttggtgatcacttatgactcccagacctctggtcttctggggtatatctaaaacccaatgagatctaactgtgtgagaaacagaagtacctctaggattctgtaggaaaccaaggttcctttcccctagacaattgcatatgaagaatccaaggcccactcaaacccaccgcagacaacaccatgtgaataacacatgctcagttcttgttccctaaatgacccaaaaaaggtgaagacagtattagagcagtccttcctctggattcaactctgaagaaattgctatgagttatattaaatccttgggattgctaactgaaaaggtgccctttttaacttcaagattttaacaaacatatcaatacatgaccccatctaagtcaagttttcacttgtaaatacatctagagaaagtcatgggacaccctgttttcaggaaactcaaaggaaaattttttaatagattagcttcattctcatttatttttcaagaacaaaattgtaaaaacatttaaaattttaattacattcttatttatgtgtgtgcaagcatgcatgcatatggcaaggcacatgtgtggaggtcagaggataacttagaggtatcacttttctccttctctgttgtggcacctggggacttaggcttagtggctgagccatcttgactactataaagacaaaaaagatgaagctatcctagttatcttactttgtttcacaatggctacatggtgatgatggtgaatggcttctaaaatgcaacccaattttactttctgttatttgagagagcaaaaaataaaatacctggtaaacactttttgcgatggtaatagcaaaattagaattaaacagggaaaaatgttatctgcagaaacaaattgaagaaaattgaactgattatacttttaaagagaatcatatgttggtgctggacaggtggcccagtcattaagagttcttgctgctcttgcaggaaatcccatatcagttcctaccacccatatcagttcctaccacccatgatgaaggggctcacaattgctccagtggcccattgccctcttctggcttctgggggtactgcacacaggtggcatacactcatacttaatttgggttttttaaaaatcattcaaaacataatttaaagtctacataaaaaatcacaaaatactctctttattgttgattctatattattttaatgagagtctaaaaataaccataactctactgccaaatttcctttttccacctcttctgtttagtttaaatgtaaaatctgctttcacatttgtccatggatttatagtgcttgaaataaaatgacaaattattttgtggtttagtggtttaattgcctgccaaatttctaaactttcttagcatgtgtgttctgcattccctttgcctcattttctatgtaaaatggaaatgaataagtgctttttggaagagcttagataatttcaaggtctgcttcctgccttccttaaagtgtacgttcaagtccaagatatttgttttcttttcactttgcaggaaaaaaaaatgcctcgcttctcccacaaattcagtataggcatactggctgccttccttcttgggcaggctgcctaagtatttaattgtccaatcactacatgagaatcattttgcccaacagtaaaatgaggctgcctccatggtagcagggagcagctgtcaaaggcataagctctgctaccctgcaggctggggtctggcacagaaaagattgcatctccatttccaagatgggaagaatggtggtccatagccaacggcacattactgttttaggaacttggctttgcctccactggcctcctctgtcatcctcatcacctttttcctttctgtggcatgctctcaccactgatcttcacagggttaggcttgtttttgttgttttgttttgttttgtttcgttcttgtgctagtatctctttcacttccatagttaattccccaattgcttgctattgtgctcagtaattatcagtttcaagtcagctgtgatttataatgtcaccttgaatattcagaattgatttcaactcccctctgagcacactctgatggggatttgggaagatgctgagggagagaggagtaaactagggagttgggtgactgccagtgatgagaaaccctgtgccaaggagtggccagggacggaatcacagtctcacagagctttctagttaattagatttggtcacatgacctttgcaactctgccaattgcaagaaataattgggcatacattgccaggctgccagggttctgctgccatgtctggttaagacgtgaggtctctactagggtcatattcacagagcacatcatgaaatccctcacactttcctagtgaagtttattttatctgcactttgttggccttcctttacaccttatacttgtcaatgaatcaagcactttgtatgacttttctgctcttaagtcctttgggaggatggtgtgaagatcagcttaccgtgttctttctcaagtctcaacgtgtcttcatttcttgcatttgatcaccgctgcctcactggtatcgcacacttcagactctctactgccatccctctgtttttaccatggcttctattgctctgcaactgaaagccatcactaacagagaatgctcagattcccctacaagtgagaaaaaccaaaggacttttgaaaactggaggagttccatgatgatctgaaaaggatgcctcacctgttctcttaccttgtctgtgttcttcctttgtagcttgtgaacagacagggtgagcactgaaatgcctttgtaatacaatcctgtgtcctgtgctcaagacaagaagagcacactctctcctggcaatccttctaagagttaacatcttaatgtttccagaactcagggtcccctttaaatggttcagtcttgcaaataaaataacttagaaaaaactttgaaggcaacttgagagcaatttttttggaatatgacaagaaaaaataagatgggcaatctttacagaaggagatggaaggaagctggagaagggtaggtggtagttacaattgttgagttaaaaggaagtcaggtggagtcagcaacggaagtcagcaagcagcaactttgaggagggaannnnnnnnnnnnnnnnnnnnnnnnnnnnnnnnnnnnnnnnnnnnnnnnnnnnnnnnnnnnnnnnnnnnnnnnnnnnnnnnnnnnnnagggagggaggattctcagaaaactggcacagggatgtctcttcagagaatatgaaaatgcacacacagaggttgggacaaataaacttaagatttggattggtgcctagaaagtaggaatagaaaaaggaagaatataaaggttaaactttctgtgttatacctcaggaaaaaaaaaggattgttagcagtgttaattatctgtgttgaggaataggcttctggggaacataaatgggtgtctcattaagtggatacttactgcttgtatcttcttaagatatctctaggtactaaaagcaggtgccactaaataatcttaaattatatctggaacatttcatttaatatttattaggtagcagtttgtgcatttgacaataacttattataaaaagcagcttgtatattacatgctcctgcaggccatatacgtttctcattcattgatcttggttagtgacctgtgaatctgagtgcttctaggttaaagttgatgtgtcacttgtctccaaatcagggtgcagcactgaccatggggaatctgagaagctaagaccttaagttctgttcttatgtcaaatctttctgtaccactgctacacttgtgactcttagatttatgtgattggtttatgtttctcaccaggctcaccaattcagtggcacctcatggatctctgaaactcaacatatttaaatttctgacttcacacctactttgcaataggctgcacatttccagtttcccaggtccttgttcccatatgtgtctcttctctctggtaacttacttccttgttactgtcctcaaacaccatggctgaaagcaatataagaaaatctatctgtcttgtgatttcaaaagtctagctgtccataatggcagagacagagtgggggcagaagcaagaagctgagagtttgcctctcgacctcacacaaactgaaagtgtggcaaggcaataaattctcaaagccaacctccagcactctattaccttctgcaatgaacacatcctgaatgttcagtagccaccaggcagcagcatcaatgaaagatgaggtgcttaatagctagagcacatgggggacaattatttttatttcacatcaccatactatgatatctgctgccttctaatattggctctactttcaaagtatacacaaggcttaaaatacagaatgtcattctgtttctgcatgtgtttactgtttgtttactattatatcaatgagaagcaacctatgtattatctcttcatttgcttagttttttgtttttgttttttttttgtgtgtgtgtgtgtgtgtgtgtggttttattttggtttgtttgtttcagacagggtttcttgtcgtctaggatgacctccaagctattgtcaaagatagccctgaacatctgatcatcttgcttctacgtcaaacaagtgccatcatgcccagccaaaactgagtaatcttttgctctggtccagccttggctctctgacctgttttcttccctacactaagaaaagtacaacctgaataatcttttcaatgttcagtctcacttttgtcacttctatttggaaacctctcttagtttgttctgcagagcacagtcgtcttttcctttctgaacaacagaaacagtcttctcaagcttttccttaccactctgtcaactcactgtatagaaatgttttggtaattcacagggataattttatttgtttagtagcttagtgttataaaagtcagaaacaatgttgcttatgtttagaaagtgtgacaagacaatgagttaaataaaattcataaaacatgagaactataaaaattaagggaacttttctttaggtttgacctcatgtgctagccttcagtagaccagaccaaacaaaacacagtcattaattactaaagtgacataatagaacagaaactttcaggaaatagagaggcacataaacagattcccttgtcccccaaacattagatagtgttcctgattccgtatagtatagcattctccttggttccttccaggaaagcaaacagaagaaataatctaatgcaatcctatctacttcctcccattgttttgttttctggtttctactttgcaaaacccacaactgctgctttgagaaagccctcattctatcacataaaatgaagactacccaaattattaattacaatgaaatcctacttgatctatgaatgcatttgtgtatttatgtcttttgacagaacaaatgaaaatgcattgcaaaataaatatgcttgagaataaagtgaacgcaatggaagaccatgattgttttgcagctgggattattgaaaggatgatttacagaggtcatagtccagcttttggacaccgtctcatacaaagtagtcaaaataagatttctgttatcgtgaagaatattctgtcaacaatcatgatggtggtatgggagatagcatcatggcatgtgaaaaagattagctctgatagtttgtttagtctgtaaaagaaagattgacatttctcagtaagaaaagaacaggctgagaagcagcttagaagctcaaatccatgtggatgcataggttagatactgagaaactgaatgtgtcatgagataacacaaaggggggcagtttggagaacatttttctctttgtaatacagattaattaatgaatgtaagacagtgatcattatcattatatctaacaattattatttactatggattggaaccgattgaaaatatgcacttctcctttcatttcaccatcatcagttttatggcataaattcccatagaagatctcagggctacagttcaaagccaggcttaattcaagggcatgttactagcctgtggatatgaaatactttgctgaaacaattcatataacattcagacttacaccactcatttcacaaagtagccggagcctgtgaccagcagagtacagtttgcagtgaggccatatgcagtagagagacctcagggtgtgacataccaggttggaatgcctggtgctgacttgtggtctcacttcaccttccacactggccagtcctgatttccttaccgtgagttgtcatgcctttcacttttacttataattaagtttgtaaaatctaaaaagatgctggagtgtaagataaaaattattgtcacttggttttgaaatattaggagaatacttttcctggaactctttggattcttaatctgtcaaataaaattggtgatattcttgacactgttgattctaaatagtcaacaagatggcatatttacaaaatccaaagatccttattaatgataaagtatgtaaaatatagttatttgtcatatttatgtgtcccagtgccttataattgtactagaacaaagttcacaaagtgtatattatatgagatctaatttatataatgtatgttgatgggggaagtacttctgtgtatgtttatcttatagattgttgaataaagttctttttggccaatgaggcagcaagttagacaggactaggagtcaaagtggattctgggaaatgtagtagagaagtggtgatctagtcaggaagtgacataacaaggagaaacatattcaagcaaggagaaacaggaagtgtccctttccccctccgctcttcctccagtggcacaatgtaatccaccggcaaggaaggacaccaatggaaggtgttctataagataaatcttataaaatatatagatttatgataattaagactgagctaacagatgagaatcctagtcattggccaagcagcatttgaacctaatataagtttctgtgtattaatttgggccctaacttgggcgggttgctgacgtaaagcacacacgtggtggtggtgcttggaggcctttggcagaaagatttattctaacagtatatttataatatttgtctgcttctgatatatatattatttgacttaacaagtatcagtgaaatatcttcagtatgttaagctggataactattttgtaaggcatagagatactggggatctcctgtgtttactgtgatactgatgagacaataaggccacacttgtgtgaagaactgcaaaacatctggcatggcactgccatcaaagagacttgataacttgctatagttgcagagatactggtatactgttaggtgataggaaggtccctgataaaggcctttatcattcatgggacagccagtatcaggaacttcatattccaactgaaatatgggctgtttgtatgatttgatgtagaataagtgatgctcagaatacatgaaaacatggttttaaatctcagtgccacataaataagtcagctgatcaagtaatgaaaattatcaaacactgaaaacactttacaaatagatgtttagaaatttgcttttctccctgatattctaaatgagcttgtaaaattagaggagaataaatttaatgaatattaaaatgttaaatcagttgcatttaataataacaaaatgttttgttttccaaattgaattaaagctgtaaaattggcttatgaaaagaaattaatagcaatcatgatttgaaaagcttgatgtcgccaaaatacaacacttacataatagcatacataactggggtgaacatatgaacatatacataaatttgtgactcttattaactgtttacattatcttcacctgcctttcatacaaattattttaacaccatggtattttgtgacagattgagaaccatagtttaaaacaagaaaaaaaaatagttatagttttctattaaaatgtattttttttggaaaatatattgcttttttgtagtctttggggaaagcacattaattgacttctttccagtgaaataaatccttctccttaagtctctgagtcatcaggagaaacacctctttctaccaacatgaaagcacccttaatacttgaaaagtcatcttttgttttgaaaataagggacctagcagagcttaacccagagtaaaaaatgcttacttttctccgtgtgcataaaatacctggtaaaagcaacttgagggaggaagaggttattacagctcaaggtttgagtgtaccatccataacagtgggaaagcatgaccacaggacagtcaggtagctgatcacgttgcatctgtattcagataggagagaaatgagtgctcgtgttcagcttgctttcttccttttcactcatcaggaccccaggcctcagaatggtgcctcctacacttagagtgaaccttccactttcaattggtcaaatctaaaatccctctcaaagacatctaggtgatctagattcttttaagttaacagtcagtattagccatcacagagtgcatattttagttcaggcttcattgtggtaccactggaacacaatcctaaatgcatggtgctatttcatgtttatatttgtctgtgaggtgcttgaagctgtctataaaggtccactctcaatactttatgagtagaagcggaccatgcaaagcaggaagacacttgggaatgcaaactttgtccaagataaaaaaaaaaaaagcatttgatgataccattcatttgagaagaatttacaatagatctaaattagtcccaggttggtgaagaatttcttaataaattaatgcttccttttcattacaaaaccacccagcaaagagaaacaaaactagggaagaaacttggggagagtgcaggaccacaagtggggcaaatacagagaatgagaagaatcaatcaagtcagggaccaagcccacaggggaggtgtatgtagtttgtagcatgggtggtggctgtagatagtagacttctcaacgaatgcatttccaagcccagaaatagtgttaagcaaagaagaaaaatcttaaaaaatagctaaagtgtgacccagagtgtgctattaggaatacaaatccagaatgaaatctctgtatgctagtagcacatagtcaaactaacctaaactaaccattctactggtgataaattatttatgatttattatgcttgcctgaaggtacagaaagcaaaactagcacactagttagctatgtagccaggcagaggtggcacataactttaatcccaggactcaagagataacggcagatggagtccaagaccacccttgcctataggacactgaatcagagctcacacctttaatcccaggatttgagaggtaaaaggtagaaacattcaacctgagtgttaatctctagtcatgctgaggagagcatagcactctgagtgaatctggggagcagtgaaattgggagcagtctgaggattgcctctttggtctgagtataggtagaggtaagagctagtggccagctgctttacctctctgatatttagcttgaagctcaaaccctaatatctgtctctgggtcttttacttctcatgttacacattcttgcctagcttggagttcagaattagctctctaaaatgtacactatggggagggtgaaacatatatgattcatgaaggttagtctagttgtacatgagaaactttttaattaattaattaaattttctcagattggtcacagtttccccttccttctcttctccttccagtagctccccacaacctcctctgccatgaccactcctcctttctcttcagaaaagcataggactcccatgaatatcaaccagtcatggtatatcaagtttcagtaagactagacacctcttctcctattaggttggacaaggcaacacagtaggaggaagggtccccaatgcaggtaacagagtcagagacagcctctgataccactgttcagagccccacaagcagatcaagctacataattataatgtatgtgcataggtcagtcccatgcatgttctctggttggcaattcagcctctgaacccatatgagcccaagttagttgattctgtgggttttcttgtggtgtccttgtcacctctgtttcccataattcttccctagctcttaggaaaacataaatcaaaatgactctgagattgcatcttacacctagcagagtggctaagataaaacacacaagtaacagctcatggtggagagaatgtggagcaaggggaaaactccttcattgctgatgggagtgcaaatttgtgcagccactttagaatcaatatggaagttgctcagaaaacttgcaattgacctacctcaagacccaactaaatcactcctcggcatacacctaaagtatgtgccaccataccacaaggacatttgctcaaccatgttcacaaagtaatatccagaaagtggaaacaaacctagatgtccctcaactaaaaattgatgaagaaaatgtgatacattgcacaattgagtattactcagctgttaaaaacagtgacatcatcaaattcatcagcaattggatggaactagaaaagatcattctgagtgaggtaacccagattgagaaagacaagcatgatatgtactcacgtatacgtgcctattagctataaagtaaagggtaatcatattataatccacagacccaaagaaactatgtaacaaggaaagcttaagcaggaacacacaaatctcactgtgaaggagaaatagaataggcatcacaggtagttgccaagggatctgggtgggggtggggtgggcatgggaacaggagggatcaggttggggaaggatggaaggagagagtactgggaaagacaaatggaatcggggcacctctggaatgagctagaaacatagtgcaatggaaactcccaggaatctatgaaggtagtccctagctaagactcctggtaatagaagaaactaagcctaaacctgccatctcctgtaaccaagcaagatttccagtggagggagttgagacaccaacacaaccacataacctttgacctataatttgccctgcctacaaggtatgctgaggtaaaggtggtgcagaaattatgggagtggccaaccaatttctggtccagcttgaaactcatactgtaagagggagcccagcttaccactgacactgcttggagggccaggacagagcctgtacagctcagaggcctagggtagaatcaaacatgattggcaaagaaaaaaaaagaagtcaatgaaatgattcttaatgatactctgctatcctcataggttgttgcccagcccacttctcatcagagaggtgtcacccagcaactagtggaaatagatggagagattcacagccaaacattaggcagacctgggagaattctgtggaagagggagaggaaggattatggaaagggatagctttcagtgggatttgcaagcctcccaaagcagaatcccctttctctcttatgtttatctcccttgttaaaatttccattaaggacactagataatgtttttaagtaaaaatgttctaaacaaagcatatcaaaagtggaaagcattgtcagtaacagttatcaatactggaatgctgagaggtgggcttttcatcattggttccctccccctacacacacaattttagagaatgtgcggaagagtctgtgtggaaatcccagtggagggtgggggagatacagtggaatgtgttgttcacatcagcagaagcctggtgcagtgatcctctaaagacaataacattcatcttatttcttttgtttaaatggaaaacctaaatgttagtaaagagtagctcatcttgccagaaaaaaaatacttctggttttctgtatataaatttctggatttacagaaagaaatcagggtaagttgatgttcatagctgatgtggaggctagctggcctgtgagcctgtgttctgtctctgcttctcttcctacatctgtcaccctgtctgacttttatgggttcttaagaacagtaatcaagtcacaagattttgttttgagacagggtttctctgtggctttggagccagtcctggaactagctcttatagaccaggctggtttcaaactcacagagatccgcctgcttttgcttcctgagtactgggattaaaggtgagccccaccaccgcccagctgtcacaagattttttttgggggggggggtaaacatttgcctaatgagtcatcttccaaatcccccaaatttagaatttttaaagtaaaatgcagtataggaactgatacaccatgtgaaacacattcctatgacacctaacttttacaataggacaaattgtttttaatagccaatagaaggaagatagaggtaccaagggacacagagaaatgaggggctaaactgaggccccaaagacagcttggaagaccccagtgtcacataactgactgagcaacagatgaacactggaatctctggcatgaactacatggtgagcaataaagactttttgaagtaaatttagatttagctcagtagtagagtgctttttcagcttctgtgagactctgggttccatttcacttctgtcatgaataaacaaaccagcaaagaataaataattaagtttcatgcacgggcagtcatttaacttgttttaactcccagaaaatctgggatacaacaatgactactgcaggacaagtagttagaggttggtaaatttcattgtattctacattctcaatcttttcttattcccattgtttccatcctggacacatgagattacaacatcagaagaaatgagagctttcctagacagctcctgggtctggttctggcaaactacagtgtagggtaagctgtagccatgcctacttaggggctgactacaggtgtgcctgaccacactttcgagggcgtgatcagggtgacatagagcgagacttgaaggggacttcgtctctcttttggtttcacttttcggtttcacttttaggctggctaggttgctctgtaagtaattaaatacccttatatttccacttggctccgtattgataatttcccactatactacagccaatggtctgtgtgtctgttctcagatgtccatattaaaagtattttgtagcctattgtaaaattccacatatgcttctccttttctggtttgcttgtatacattaaaatactgtttacacagagagacacatacaaccacacattcaaacataaacatactatatcacacacagatgtcatctcatatcagacttgactttaaacccaggaccaagccccttcctggaatactgaccctctgagtgtggggcccaccactgaaaattggaaaagaaactttttctttcacttgggggatgggggattctcctgaagttacccttgttttgaaaggcatatagtaagctccattaagcattgaattgaagaattacatggtatataggctatcctaaagactacagaaatgttaataccccatcattacacagaatataacaaagacttggaggtatgaggctgatagatctttggaacaaataacaaaatgcaaggaaagggaaagtaaaatcactattaacatggcttttacaatttttttcttaaaatttttaacatcactgcaccaaaaggagcctcaaattcacagtgttaatgtcacattagcatatcttttcattctataaactatatgtaagttctttttccacagggttatggtagtaattattatgaaaatgtattttattccatatgtcatgaaggaagcagcatctcagacagatataggtcagtaaccatggtaatagtgcactctatagaacagcataataatgccatgctttccttggaagggacaagttcagggatgtggaactgagtgggtactaaaggagaaattatcgggtgatctggatggacagcatcctatatgtgttttcagacagcacatgaggttctttccaagaaagtttcatgtgcacaggcaaagtaaagtttgggttatatgatcagtccagattttgctgaatgccatttatttcatcaaataaagagctaaagaggaaattcttgaagatgtgagctgtggtaactgtcatccaaatgtggaaatatatatatatattatgcctcttgccatatatatatggcaagaggcataagtattatgagagaaacaaaggctacaaggtctcttgagctggcagtgtgcctgacttgtgctcatgtgaaggatggcatgaccctttctcttgcagagtgtcttatccactattgtagtgctgtgaagagacaccatggccaaggcgactctcatgaaagaaagcatttaattagggcttgcttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaactttcaatcactatagatggagaaaacaagatattccacgacaaaaacagatttaaacaatacatatctacaaatccagcaatacagaaggctctggaaggaaaactccaacccaacgaacataactacactcacaaaaacactggaaatggataatctaattttaccaaacacaaaaagaaacagragggcaaaatccacacgcaatggtaccaccaacaataaatccaaaacaaagaagaaccaatgaacagtggacattaatatccctaaatgtcaatggtcttaacttacccataaaaagatataggctaacagaatggatacgaagacagaatccatccttccgcagtttacaagaaacacacctcaacttcaaacacaggcaatatctcaaagtaaaaggatgggaaaaattttccaatcaaatgggctcaagaaacaagctggggtagcaatcctaatatctaacaaattagactttaaactgaaagcaatcaaaagagatgaagaagggcatttcatactcatcacagaaaaagtccatcaagatgaagtctcaatcctgaacatatatgcccctaatacgaaagcacccacatttgtaaaagaaacattgctaaagctcaaaccacacataaaaccacacacacttatagtaggagacttcaacaccccccttacaccattggacagaaccactagacagaaacttaacaaagaaacaaaggatctgaccgaagttatgacacaactgggtttaacagatatctatagaacattccatccaaacacaaaagaatatatcttcttctcatggccacatggaaccttctcaaaaattgaccacataattggcagcaaagcaaacctccacagttacaaaagtgttgaaataaccccctgtatcttatcagaccaccatgtattaaagctagaattcaacagcaatacgaattgcagaaaacctatattttcgtggaaaatggataacacccaattgcaccattcctgggttgtggaagaaataaaaaagaaattaaagacttcctagaatttaatgagaatgtagacacaacataccagaacttatgggacaccctgaaagcagtgctaagagggaagttcatagmactaagtgctcacatgaagaaactggaggaaagtcacattagagaattgacagaacaactgaaagctttagagcaaaaagaagcaaacacaccaaggaggagtagacgccaggaaataatcagcctgagagcggaaatcaacaaagtagaaactaggaaaacagtataaagaattaatgaaataaagagttggttctttgagaagatcaataagatagacaaacctctagccaacctaaccaaaaggcagagagagagcatgctaattaacaaaatcagaaacgaaaggggggatataacaacggacactgaggaaatccagagaatctttaggtcatactttgaaaacctttattccacaaaattggagaatctaaaggaaatggacagctttctggataaatatcacttaccaaaattaaatcaagatcagataaatcaagatcagtttaaatcgacctataacccctaatgagatagaagcagtaatcaaaagcctcccaaccaaaaaaagcccagggccagatggcttcactgcagaattctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaaatccatcaatgtaatccatcatataaacaaactgaaaaagaaaaaccacatgatcatctcactagatgctgaaaaagcctttgacaaaatccaacatcccttcatgataaagatcttcgagagaacaggaacaacaggaacatatctaaacatgataaactcgatatacaccaaaccaatagccaatatcaaagtaaatggagagaaactcaaagtgtttcctctaaagtcaggaacaagacaaggctgtccactctctccatatctcttcaatattgtacttgaagttctggctagagcaataagacaagaaaaggggatcaaagggatacaaattggaaaggatgaagtcaaactttcactatttgcagacgacatgatagtctacattagtgacccgaaaaactctaccagggaactcctatggctgataaacaccttcagcaaggtagcaggatacaaagtcaactcaaaaaaaaattaactcaaaaaaatctgtagccctactgtatacagatgataaactcaatgagaaagaattcagggaaacatcacctttcacaatatccacaagcaacataaaatatcttggggtaacactaaccaaaaaagtgaaagatctgtacaataagaactttgagagtttaaagaaagagattagagaagataccagaaaatggaaagatctcccatgctcttggataggtaaaattaacattgtaaaaatggcaatcctgccaaaagcaacctacagattcaatgcaatccccatcaaaatcccaacacagtttttcacagacattgaaagaacaatactcaactttatatggaaaaataaaaagcccaggatagccaaaayaactctttacaataaaggatcttctggaggcatcaccatccccgacttcaagctctactatagagccatagttctgaaaacagcttggtattggcacaaaaatagactgatagaccaatggaatagaattgaaaaccctgatattgacccacgcacctccgaataccttatttttgacaaaggtgctaaatctatacaatggaaaaaagatagcatcttcaacaaatggtgctggaacaattggattcggacatgcagaaaattgcagatagatccatacctgtcaccatgcacaaaacttaactgcaaatggatcaaagatctcaccataaattcagccacactgaatcttctagaagagaaagtaggaattacccttgaacaaattggcacaggagaccgcttcctgaacattacaccagtagcacagacattgaggtctgcaattaataaatgggacctcctgaaactgagaagcttctgcaaggcaaaggaaacagtcagtaggacaaaacgaccacccacagaatag

SEQ ID NO: 5 - DNA, 68962 bp, Cricetulus griseus
  misc_feature (16317)..(16326): n is a, c, g, or t
  misc_feature (21699)..(21708): n is a, c, g, or t
  misc_feature (29578)..(29606): n is a, c, g, or t
aagtgaatacacatacatgcaggtaaagtgctcacgcataaaaatatatctttaacttaaaaaccagctggtgctggtggcacacacccacaatcccagtactagggaggaagagacagatcaagtattcaaggttattataaactacataaagagtttggggctggacctgaggtttgtaagactatctccgataaataaataaggggaaagaaatccaaaaacaaactataagctataaattgagtggttctttacaaagcaactattttgtctgggtttggttgatcatgcctttgatcctattatttaaggcagaagtaggctctctgaattcaaggccagccttgtagtcattatagctccaggacagtcaggactgtcaggcaacgattcctcaaaacagaacatactattttgctccttgaactggggccattttttttttctttttaaatcaaataatcacatcttcattaaggatgctttacttgctgattaagtggagataaaaaatttaaatgtttaagccaggcagtggtggtgcacacctttgtttcaagcacgtgggaggcagaggcaggtggatctgggtgagttcaaggccagctggtctatgaagtgagttccagaacagctggggttgttacacagagaaacaacctgtctccaaaaacaaacaaacaaacaaaatttaactgtttatactcagtgaattagtgagattgtttatttttttattttttatttttttggttttttgagacagggtttccctgtggctttggaggctgtcctggtactagctcttgtagaccaggctggcctcgaactcacagagatccacctgcctctgcctcccaagtgctgggattaaaggcgtgcaccaccaatgcccggggagattgtttatttttaaacattttgtgtatatagatgtttttcctgtaggcatgtctgtgcacctggtgcctgcaatgcccagggaagccagaagagggtgtcataccctttgggactgaagttacagatagctacagactgccacatgtgtgttggaaattgaatctgggtcctctggaagatcagccaacacttttaacttctgtgccatttttacagtccttaaataataatgatgatgatgatgttttttttttttgagacagggtttccctgtggctttgaagtctgtcctggaactagctctatagaccaagctggtcttcaactcacagaaatctgcctgcctctgccttccaagtgctgggatcaaaggcgtgcgccaacactacggggcctgaaattatttttaatgaaggagtcttttgttttttgtaatagggtctcattatatagtcctttttggtttgcaattcactgtgtagactaggcaggtgttgaactcatccatctgcctctgcaggacctaactcaaaaaagatattcattcattcgtttatttatttaatgtgtggctttgtgagtgtgagtaccaagtgccgtagagaccagaggcattggatgtaattggagttaagggagttgtaagtagcttggaactgaacttgggtcctatgcaggagcagtctgtggtcttcatctctgagctatctttccagccctgaattaatttttaaaattatgcagttaatgtttgtgtgcttatggggcacagggccatgatgcaaacatggaggttaaaaaacaaattgtggtagttggttttctccttctacttataggttctagggattgaacccaggtttttaggcttggcagcaagtgtctttttagccatattgctggcccctaatttttattttagttttgttccttttttttttttttttttttttttttttttgagacattgtttctctgtgtagtcctggctgtcccggaactcaatttggagactaggctggttttgaagttagctatccacctatctctgcttctcaagtgctgggattaaaggccagcgcaactaccaacactaattctctttaatttaaaattttattattgtgggccagtgctcacatgtggagaccagaggacatttttaggcaattggttctctccttccactcttattaaacttaggttgtcaggtgttctcagcaatcactcttacctactaagctatcttgtgtagctagcttttttgtcagactgtcttgactgctagccaaaaaataacaagacagacttcttaattatgaaagcttagatttgtccccaacgagctcatttgtttcctttgttttttgagacagaatttctctgtagttggagcctgtcctagaactcaaaataatatttttctcaaaatgcaaaaatttgggggccagcaaaatgactcagtaattaaagatacttgctactaaacctcacaaccgaagttaagtcaccaggacccatttaatgcaaggcgataactgactcctgcaagttttcctatgacaattccaacatggcacacataaaataaatgaatgttttatttttctgaagagtattttttaaaagttggggctggggataatatagcacagtaggtagtatcctgagccagcatgcatgaaaccctgaatgattccctagcactacataaagcagggtatactgaagcacaactgttgttctacattcaggtagagatagaaaaccacaaatgcaaatccatccttacctacaaagtaagtttgagaccagcctggaatacaggggatcctattcctcctaaaaagagcaagattgttgtagaatatttatttacactgtagagatgcgtctctacttaaggcaccttctcgttgatttaatacaaagctaaatggccaatagctaggctagagagaataggcaggacttctggtcagagagaggaagtcagagggacgaatcaaggcaggagagagacgtggatcgagtctgtattgtgttgaggaaaggtaaaaggcacatggcagaatgtagattaataaaagcaggttaatctgagttgagggccaggtggtggttcatgcctttaatcccagcacttgggaggcagaggcaggtgtatttctgttgcgttcgagttccaggacagccagggctacacagagaaaccctgtctcaaaaaactgggggaaaaaaaaaaaaaaaaaaaaaaaggaaagtcagagctgtaggtcaaaagtagagtgcctattttgtatttgtgaggccttaggttcaatccccagtcctgccagtctctctcttttctctctctccctccctctccccattcccctctcttgggttttgtgtagctctgagaaatcctcttgcctctacctcctaagtactgggaatacctgacttcctactgagatctttaaagcagaacaggatgcctcagtgggtaaaaagatttgctacacaaattgagacctgagttcagtttcctggatcctactgtagaaggaacactgactctctgacctccacacaaaaaccatagtaaaataaaaatttaaagtaatacaattatggtaaaacaaacttattctgtataatggaaacaaccaaatttacaatctgaaagttgtcaagcacaagataggataaggagtgtgattcatagtgctgagagacagttggaagtaaggtaaaatgtttaaactagctgttggggtatttggcatgttctagttaattggttatctgctgttataatgtaaaaagcagtgtagtaacatacccagttagtacaggacctcttgtgaaagtaaatatcagggtgtctgtttaagaaaatgtgtggccttttctaactgacacatttcatttgtagtgtctgaagtagtgtaatgagttttggttaatgtcttagtcactcttctattgctgtgaaaagaccatcagcaaggtaactcttagaaaagaaagtattaatttttgcttacagtttcagtggtggttcattgtcaccatggtggggagcattgcagtaggcaccaagcatggttctggaaaagtagctgagatatcacacatctgttccatgagttctaggcagagatactgggccttcaaagcccacccccagtgatacaccttttcttttcttttttggttttttgagacagggtttctctgtgtagctttggagcctaacctggcacttgctcttgagaccaggctggcctcgaactcacagagatccacctgcctctgcctctcgagtgctgggattaaaggcatgtgccaccaacgcccggcttgtgatacaccttttctaacaaggctgcactacatctcttaatccttccccaaagttccactaactgggaatcaagtattcaaacatagactcaatgagaaccattttcattcaaagcatcacagtttcttgtagtttatgtagtaaaggataacctgggagtatttgttgcaatggtgtctctatagcctgaaccatgtaaattaagattatagggacactgatccttgtagtctctgagctttccatgcttggtaagcagcattcaggatgttgtcttctggaagaataagtgctctgatcacggagctaccttcccagtctctcagggtctcctttatcctagactggcctggttctctcattataactgaggatgaccttgaatttctgatgtcttttcctccccaggcctagaattacatatgtatgtcactatatccagttttatagggagctggggattgaacccaggttgtgtgctagatgagctgtctaccaactgagctgcatccccatccctgtggtctcataaacacttaagattatgaagacaagtctggaaacagaatagctaaaataagatctgagttgattgtagattctgtagaatccaaaggaaagcagtccataaaaggaaggccaggagagtgtggtcagttataccaggggctaaagcaacacagtaggttttgtggttagtatgggcagcataatggaaccacacatcaaagataagagaacagaggaagggggggggcaagggagagggaaagctgctagggaaataatctaaacagttcttgcatactattttagatattttctttcttttttttttaagatttatttattatgcatacgacgacgatctgtctgcatgtgtccctgcaggctagaagagggcaccagatctcattatggatggttgtgagccatcatgtggttgctgggaattgaactcaggacctctggaagagcagtcagtgctcttaacctctgagccatctctccagcccagctattttcttttttcaattaaatttattttatgaatatgagtgtatctgcacgtacaacttcatgccagaagagggcaccagatcttattatggatggttgtgagccaccatgtggtttctgggaatttaactcaggacctctggaagagcagccagtgcttaaacactgagccatctctcttgtctgtctgtctgtctttcccccgaccgccccccccccaccaccactcctttgtttctttgagacagaatctctctgtagccatgactggcctggaatttgctatgtgtagaccaggctggcgtcaacttagatctcccagtctcagccttctgtgtgctggaattaaaggcgtgcattaccatacttagctctatttgaaaaaatattctgaatgttttattttgtgtgtcacccccattagatgtttgtttttgccatgatttggaagttttgcttacaatgccttctttgttgcagattttgtattttgtacatacattattttgtatattctgtatatgatgacttcggtgagcaatgatcgttgccgaggtgctcgggaaaaaccacagatgccaacaacacatgcaggacagccacagaaacaagtgatacaggtaagtcttgggttagactaaaagagtgagggagaaggaatgtgttaatagctcctttctagggaactcaggatttagcattgtgtttacaaactaaataagtagtatacgaaagggatgatgtgacgatggtacaatcgaacggtgttccaggagaagcatgtgtttaagcctgaatttcagttgttatctctgctacagcagttcccttccttccttctttgtctcatgttccagtttataccactaggaattaaacccagggcccctgtgttctagaccagcactctactactgaactacacgcccagctcatctgttattctttcaagtgaagtgagacatgttagtacagcacggaacatgtctgtactataatgatccagttgacaagcttcttaacagaaacagtatctttcccccttcatatgttcattattatccttacatttactaaccgtgtgtgtgcaagcttgtgcatgcacacgtgcacatagatcattgtgctttttgaagtcaaaggacagctagagagagcgagttctctccttgtaccatttgaattcaggatggaactcgggagtcagggttggccataaagacccttactcactgagccatctgcttagagatgttgctctgcttcagcttcccaggtgctggggtgtcagacttggactaccatggttcacttttatgatactttgttttatttctgatattgggttgggacatagggttttgcatatgaggcaagtattatatcaaccagttatgtcccttattcttttcaggagcttcatgtaatttcatactgaagtgttctattatgtttggtacagagtagaatttttttttttttttaagattttatttatttattacatatacagcagagggcaccagatctcattcaaggtggttgtgagccaccatatggttgccgggaattgaactcaggacctctggaagagcagtcagtgctgttaaccgctgagccatctctccagcccctagaatttttttttttttttaacaaaatttttgtgttaaattgaatagaaaaatagcttttttttttttttttttttttttttttttggctgctattaacagataaatatctcctatgttagtgcttacccctaagttctttaactctgatcagtattcttcacaaagaaagactgctgtgctgagtgttgtaacacagtcctttaatctcagcacccaagacagaggcaggcagatctctgagtttgaggccagcctggtctgtatagcaagttcaggctagccagaatcgaacaacataggagaccctgttgttagagaactgttgcggctaggctatccttttaagtttagttaatgaattgtcttgaattaatgaagaaatataggtcagaataaccaaaggtgaagggatgatgatgatgatgatgataaagttagtctttaaaaagaaattgtatcattaaaaacaaaaaagtaccaggcgttggtgccgcacgcctttaatcccagcactccctttaatcccagcactcaggaggcagaggcccgtggatctctgtgagttcgagaccagcctggtctaaaagagctagttccaggacagcctccaaagccacagagaaaccctgtctcgaaaaacaaacaaacaaaaaaagtatgtataacaggctttcttttgtgcctctagccagctcccaaatcgtgacaagaagacttgttaattagttatgaatgcttggccttgtgcttattccactagctcttataatttaaagtaacctgcttctctgtatctacattttgccttatggctttgtacttttcttttattctgtatgtcttaatttttcctgtttcttccatgtctggctgtctggcggctgcctgactggctggcccctggcatctccccctcgccctcgttttcttttctcttctccctcctctctcctgagcctagattccttctacttattctctctgcccaccaaccccgcctatccctcttctgcttagctattggccattcatctttttattagactttaggcaggcaaggtgaaacagcaacacatctttacataattaaacaaatgcagcataaacaatgtcacacatttttatattgttagacaaaagcagcataaacaaaagtaatactcttttacttgataagtaatattccataacaagtatgagcttttgaaggaaggccaaataaatgtgaatgatgcaaatggtaccctgtataccttgctagcagacttggatggattgtcagccagtttgcagactagaacagggaattagttttgttttgtttttccttctaaaagggttttatttttattgtgtttcattttcagtagtttgagacagggtcttgctatgtagcccaggatggcccagagctttcgggtatccagtactggtctcaaaactttaaatttccattcctcagcctccctggaatttggactacattaaaagattttcactaatagcctttctgtggagcctttgagggatgacttagattgcctaaaggaaaaagctgctgactgatcaatgaggatgagttcgagatcctcctgcttctttttttgggctttttgtttatttgctttgctttttaaggtatttattcaaaagtaatattacatatatgtgcattttcctgtatttctgtctgctcactgtgtgtgcctgcctgtgacggccaaaagagggtgtctgttggatcccctggaactggagttacagatggtgagccaccatgtgggtgctgaaaattgaacctaggtcctctggaagagcagccagtgctcttaatggctgagccatctccaatgctttttttgtttgtttgtttttttgttttaagacagaatgtcatagctcaggtcggtccagcttgctatatcatccaggctgctgtctaattgaatgcatacttggtttatagatgtataccatcgtgtggcttttcttttttatattttatttatgtgtatgggtattttgcatgcataaatatctgtaccacatacacagttaatagacagttgtaagctaccatgtgtgtttggaaatccaacctgggtccttgggaggagcaatcagtgatcttaaccaccaagccatctctagccctgtttcctgtttttttttgttcttttgttttgttttgttttgttttttaagattttattttatatattatgtatacaacattctgcttccatgtatatctgcacaccagaagagggcaccagatctcataatggatggttctgagccaccatgtagttgctgggaattgaactcaggacctctggaagagcaggctgtgcttaacctcttaacctctgagccatctatccagccctttgttttgttttctttaaagatttattttatctataagataaatatacataataaatatatgctctgtctgcatgtacacctgcatctcataagaggacatgagaggctgggcgttgctggcacacacctttaatcccagcactcaggaggcagaggcaggtggatctctgtaagttcgaggccagcctggtctccagagcgagtgccaggataggctccaaagctacacagagaaaccctgtctcgaaaaacaaaacaaaacaaaacaaaacaaaacaaacaaaaaaaaaaggacatgcgatcccattacatatggctatgagccactatgtggttgtggtattgtaggatggtgagattgctgagtggttaaagctcacaccatataagcctcgagttctgagtttgacaagcccaggaagacacaaaaagctgttttcttttacatgcatgccatggcatgtacaagcctgtactcacatatgttaataataataatagtaaaaagggctttaaaaaatggaatcttatgaagttgccccaagatggtctcaaaaaaattgtcttcaagccatcttcttgtcatagcctgacatgtagctgaaataattaaattttctttttgttcatttttgagatagagtctgttgagtatctctggctgttctggaacttgctatgaagaccaggctggcctgaaactcacagaaatccacctgcctctgcctcctgagtactgggattaaagtaatgcaccactatgcacttgctgataattattttcagatactgctttttataaaattatttggaggatactactaggacatttttatgttagactgaggtgtttcttgcttggtggtaaaacatttgactaacatacatcaagtgccagtttcaagacccagcacaatatacacatgaatacacacttggggatgtaacctagttatagtgaagtacttgcctaacatgcccgaatccctgggttccgtcttcagcaccatgaaaactggccatggtggaacaagcctgtactcatctcagcactcaggaaatggaggcaggagcatcagaagttcagggttatctttggctatagtgtgtttgaagccagcctacgctgcgagagaccccagagagaagagaaaatgattgttaaattatatgttaattacaatataaaaatatttcctgtaagttaccttaaagagtattggttaggatagtaattgttcactaaatggccagttgcagaccttttctgtccaagttaagtgctgaaagagctgttttgagtttgtgtaaacctgagtttgggtcttgggcctacatcattttttaaatttatttatttatttgtttatttgacagggtttctctgtggctttggaaccttttctgaaattagctctcttatagaccaggctgatcttgaactcacagagatcctcttgcctctgcctcccaagtgctgggattaaagccgtgggccaccaccaccaggcctgggtctacatctttattaattaggcaagatagaatttctggagtgcttttgttcatggcaatataacgtctgtcctttttagttaagtatatgtaggcatcagttctctccagtcagtgtctctctttgtcctcctcttccccatgccaactcagtttatgctcagcacaggctgttcctctcagcctccctcacttctgcctcctgaatagctggaatttcaagtttgccattagtaggataggcttgttcttcagtttcttgtcattgacatattaaagagtataggatagttatattctacattatctttgaatttgagtttatatgatactttatgattagaattaattatatacttttggtataagtaaatgtgatctattatttccccccccttttcagtagtaggcatcaaactcaaaagcttgcatatattaggcaaatgttctttctgcttctgaactgtagcctcaactggatgtgatttgtattttacataccatattatgatataataggttctaagtttgttctgttttaccagaacaaagtagttagtattcctctagtgtctcagagaggccaactggttttaaaatacaaaacagttttaattctttgcagaatgattataaggaattagaaattatatacaattgttatcagaaagtggtaattttttgtatatttattccacataaattataaaattattatttgaaatttgaggtggacatggtggttcatgcctgtaatcccagcagtaggcaggcttagaggattacaaattagaagtcagggtcggtgaaaaggctctgccagtaaaggtccttgctaccaagactgacaacctgagtttgaccttgggtctcacaagattaaagaagtgttccagcgagtgttggtggctcaggactttaatcccagcactcaggaggcagaggcaggtggatctctgtgagttcaaggccagcctggtctccagagcgagtgccagcataggctccaaagctacacagagaaaccctgtcttgaaaatccaaaaaaccctccacatgggtactctgcgaggatatgcatacccacatacatacaataaataaattaattttaaaaagcaagatggcaggatgtggtaattgcatacctttaatctcagcacacaggcagaggcaggcaaatttctgcacgttagaggttagcctcgtctgcatatacatagcaagttctaggatttccacagctacatagagataccccatctcagaaaacaatataagcaagtagaaaataaaattatatcaaatattatagaaaacaggtggtttcagggctggagaggtggctcagaggttaggaacactgactgctcttccagaggtcctgagttcaattcccagtaaccacatggtggctcaaaagccatctataatgagatctggtgccctcttctggtgtgcagatatacatggaagcagaatgttgtatacataataaataaataaatcttaaaaaaaaagaaatgaaaacaatgtggtttctgtttaagaaaatatgtatttatgcaacacaaataataataattaggcaaaataatatgcctacagattttttttgttactgttttgttttgagacagtgtcaactatttagagaagattgctcttaaatgtattactaatatccttttgcctttacccccttagttctggtattacagtcatggcttcccatgcccatctataaggatggtttaaaaaataaaatcggggctcagtggataaaggtatttgctgcccagcttaatgacctgagttgggtttttagggcctacatgatggatagagagactctgtctgtctgtcctctcacttctgtgtatatacatgtgtatgaatgggcacatacacagacacaaagaataaaatattacacatacacagacacaaaaatttaaatagtcaaaaataggtcaactgaatattttattgtttaattctcggatgacatgcaaagattgctgtgagttcctggctagtctagtttacatattgagtttctggctaacccatatcaacctctgccccagataaaataaaaattgtaaaccaaggagatattcctacttcaataagttatccaaagatttctggaagaccatccagtgaaagaaatgggttcattagagaatctttcagcatagttttcttattaattaaaaattatatatgtatatggttgttttacctgcatatatatctgtgtatcacttgtgtgcctggtgcccttggcggccagaagagggcagcagagttccctggaactggaattacaaactgttggggagggagcataaaccttgttttaagttggaattattagttgaccctgctttttcctcttttttccctaagctgtacagacctcttgacacttcttgagctcagcctggtaacttccctattatactcttatgtttggttctttgtttattgaataattaaactgtttgttgaataaagtatcttaaggtttgtagagtattttataaaggtaacacaatttaacattttgactgagactattactgttgtaatactgcgcttattaacagctgctaagtgaatcagctgtgctttcagaagttgtctagtctgtactctgtttagaattaaagcaatgatttcacagacaaatgtaaagaatgtttgtaaagttataatacttaaactaaaaaggcctagttttcaatagatcagtagttaatacatgtgagtaagacaaggaatagtgtctttctggttagaaatgtacaaatgaaactttcaaagtgaaaatatagagacacatctagggaataaaatggtgcttgaggccattggtaattattttactgaaaatctttgtccatgcttgttgatgcagatgcctttttaaaattatatattttttataaagattgatttattatgtatacagtgttctgcttacatgtatatatgcctgcacactggaagaaggcaccatttctcattacagatggttgtgagccaccatatggttgctggggattaaactcaggacctctggaagagcagccagtgctcttaacctctgagccatctctccaacccaaaattaatgtttttttttttttaaaagatttattatgtgtacaacattctgcttccatgtatatctgcacaccagaagagggcaccaggtctcattacagatggttgtgagccaccatgtggttgctgggaattgaactcaggacctctggaagagcagtcagtgttcttaacctctgagccatctctccagccccaaaattaatattttatatgatatttttataaggtcaagcaataaaatgtttcttaaagttgtctataattacagataatgaacatttcttaaggaatttttaggcttaaatgttgctgccttgctcttggaggcctagccagtggtggggtatttgcccagcccttagttcattgcctggcaccacaaaacaaaataacattctctataaagccagcagtgttgctcttgtttgttcagactccattagtttttcataccccttttcagaaagataacccccacatttcctggctttgttattctttgtattgttggactctatgagattaaaaacaaagcaaaatatttatttttatcattttaaaacatggggtatgtgtgaatatctgtgggcatgtgcacatttagtgttggcggcaggcaaccttggaggatgggcaggggtggatgtccagtcctctggtgttgcagtaacaggtggttgtaagctgtctgatgtggttgctgggagctgaactctggtcctctgaaagaataaatagcaagtgctcttaactgctgagacatctccagcccctttgcacaatgttattttgacattacgccatgaaatattttctctggaaactctcaaaccaatgcattccatatatatatatataaagtgtcatatacacacacacacacacatatatatatatatatatatttttttttttttttttttgagacagggtttctccatatagttttggctggcttgacctcacagatccatctccctttgccttccaagtggtggaatgttaagtttttttttttctcctctccctttttcaaatgtattttatttgaacattaatattttgcctgtatgtatgtcagtgtactatgttcatgcttagtacctgcagaagtcagaagagggttccagatcccctgggactggagttattgttttatgaaatgcctgtggaggccagaagagggatctgatcccctagaactggagttacagttgtgaggcattatgtaagttctgggaattgaacctgggtccttttaataagagcaacaagtgtttttaaccattgagccatctctcctgtccccacaaatttgattattttgagacagtgtctttttcttctttttttttggggggggggcatgtttgagtcagggtttcactgagtagccctggctgttcttgagcttgctctgtataccaggctggcctacttttacctgccaagttctgggattaatgatgtgagccaccacacccagcctgagacagtgtcttattcaccctaggttggtcttgaattctctgtagcagaggccagccttaatctcttgattccattcatgtacctcctgagtgctggtattataggcatgtacttccactctcatttctggttttgtgtggtgctggggatcaaatgcaaagcttcacgcatgatagataaagtggtctagtgagctagctacatttccacttcatatttgctctttgtgatggtatgtcaatatataacataactatagctctttgtcctccttcctggcaccaactgtgtgtgtgtgtgtgtgtgtatacatacatacacatattacacaagcacatttattttaaagatttgtttatttattatatatagagagttctgcctgtaggccagaagagggcaccagatctcattacatgtggttgctgagaattgaacccaggatctctgcaagtactcttaacctctgagccatctctccaggccccaccatgtgtatttttgtaataattctcatcttgttgccatcgaggagctacatgtgatctattattttacccagttaaaattgtttcctcttttgtttccctttttcttctcggtgagacattgactgtagctcagccagggctcatctcttttagcacttataatacctgtttgtccttttttgtttgtttgttttcttcagagatatttccatatactaaactcccacctctagctccctctccctcataaaaaatggataagttagcttggcagtggtggtgcatacctttaatcccaggactacggaagcagaggccagtagatctctgattttgaggccagcctggtctacaaagtattgtttcaggacannnnnnnnnncacacccacacacacacacacacacacacacacacacacacacacacacacggtaagtgctgggatttgaactcaggtcttcatagttgtgcaataatcactttaatgatccatccatctgtctaacaatctttctcccagtcaggctcttaactccaactatcacttctgtctctgtttttcttttcacttcattatctttgcacttgtagagtccctttactcagtcttcaagtattaaatagccgaagtatttcatatttcatatttcaggtcagtgagatggcttatcatgtagagacacttgatatcaagcctgaggacctgaattttattgtcataacctgaatagtgaaagtagagagaattgaatcccacaagtcctcccgtgtgctgttggattctgacttccagacagacagatatatacacacaaaatcaactagtaagttaaagaaaaacgaaactctgtataccttgcttccttattaaggctacttctgtaatagtccaggttcctgttgcctcattgttggatgtttaaaaagcttactcagtgcctagcagggacatcgtgataaatgtgttttctgctgtatatattcagttttgagtcattaacacagttgggtctggcatgatagcacagacttgagttacaggatcctatctatcagtgaaatagaagttctgtttttggttttgtaattactaaagataagaacttttttgttttctagaaagactgataattgttgaccagatagatcattgttagccctaccttgtttaactgtttggtaactgtttggtgttattctcaagatgccatgcatattttttgtttgtttgttttgttttttgtttttcaattcagagtttctctgtagctttggaggctgtcctggaactagctcttctagaccaggctggtctcgaactcacagcctcccgagtgctgggattaaaggtgtgcgccaccacccggccatatgctatgcatatttgaagggtgttttttagggtccatttttctgtttatacataaacataatttatatcttcaaacatgaaattagatcatgtcatattgtttagttttttttttgcctaatttccttgctgttgactttaccccttgttagtgtttagagaaagtgctatgaacagatatccttggattctttgtttttgtctttgagacagggtttttgtatgaagccctggctgttctggaactcactacatagatcagtctggcctcaagcacacagagagctacctacttctattgtgatcaaagggatgtgtcatgcttggctttttttttttttttttttttttttttttttaaaaaatttttccattgtacatttaaaaactccaatgtagctttggaaccatcctggatttcactctgtaaaccaggctggtcttgaacccagagatccacctgcctctgcctcagtcactgggattaaaggtgtgtgccgtcacctaacctttttttttttttttttttttttttttttttttattgggtttttttttttttctagatagggtttctctgtgtatccttggctggcctggaactcagaggtcctcctgagtgctgggatcaaaggtgtgcgccaccagcacctggcttgataatttttttgtctattgataaagtatgcctatttatgtctttgtttttgatgttactacagtcctggtttggatagagttagaaaagtgtctcctgtcaattttcagagtttgtgaattaggattaattagagaaactgactatgcttttactttgttttcatgatctatttactcattcattcattgagtcttactctgtaaaccaggctggggtcaccatggcccaggtagccctcaaacacattgtaatcctcctgcctcctgcctcggtctcatgagtgctagggattataggtgtgatccaccatgccctacttttctgggaagttttgatgacagtttagttagttaacctattttgagtctccctttttagtagatgatgctccccaccccattcttttttatgtttgtatgatgtgatgtgggcggcacaagacaaaatgtggatatgtaggacatctttgcgtgtccgtcccctttctggctagctggcccttgaacttcctaagcagttttcccatcacatcctttggtagacgtgttgggattatagattcacactattgcatcctgaccatttatgtacattccaggattttttattttgtctaggctatctaatttggtggcacatacttgttctaggtttccttttataatccttcaagtttcgtttttattgttaatttgtttgaggtgaggtctcactgtcttgctaggctgtcttccctcccctttttcagcaccgggattttaggggtgtgttgccatgccttgacatctctctaatgttcctttctcttttacttctaagattactactcttaaatcttgtctctttgtttgtggctgagtattttatctattattgacacacctgactgcctccctccctccctcccaatttgagtcaactgttgagcaagtagtagtactgtacctagctagctcagtagaatcgtaactacctacctaccttgctagagaccctggcttctgtctccaggaccaccaaaaaaacccacaattccccaccccccacccctctacagagtcttactttgtaactcagttgatctggaagttcttacacagtctggggtagctttcaacttgaccagctcctccaactcagtctcactagtgagtatgagtaagtagacccagttgtgaattaaatttaacgtgatcaacatgattgacatcccccttttttctttttccttttcttttctttctttcttttttttttctttttctttttttttttttttttctttttggagacagggtttctctgtatggctttggagcctatcctgacactcgctctgtagaccagggtttctttgtgtagctttggctgtcctagaactcactctgtagaccatgctggccccaactcacagagatctgcatgcctctgcctcctgagtactgggattaaaggtgtgcaccaccaatgcctggctttttttaaatttaaggagtgaatgctttcttctgtttttgtttgtttagttttgagatggggttttcatagcttcagtggctgggattcctgatcctcttgccctgagtgttgagattacagactagcactgccatcgtggctaattaactacccgtgtgtattttaaaagtgtgtgtgtgtgtgagagagagagagagagacagagagagacagagagacagagacagggagagaatgtgcgtgcatgaaggcatataagcttgcatgtgcatacgcataaaggcaagcatgtcatggtgtgaatatggaggttagaggtcaactttgtagagttgttctcttcttttcaagtgtatattagcgttctgggtattgaatttaggttactaggctcatgtaaccatacctttacctgctgagacatagtgctagcccattccctttggtgggtttctacttgttttgtttgagacagggtttcactgtgtagcttttactatgtgaacctcactatgtagaccaagctgttctcacaaaggtctgcctgcctctgtctcctcagtggaaggagtataagcctgtgtttccatgttcatctttttctattggttctgagtattgacctaaggtcctcttgcttgcacaagtacttttaccaaataagctgtcttctctgccccatgacaatctctaaaattttattttcatttatatgtatgaatttttttgtgcttttgtttttttcaatttgtgtgtgtgtaccatgtgtgcctggtactacagagaccagaaggagctattgattgggtttcttgaaactggagttactgatggttgtgagctgctttgtgggtgttggaaactgaacctgggtattcttcaagagtaaccattggtcttaatctcttgagtcatctctccagttcccatctcctaccccactttaaagtgaaagtgatatacaatgctacgaaaagcagtggaaggtgctgtattaatgaaacaggacagactattcctgtggaattttagcatctggaccactcatggctttgtctcactcagaagtgactctcatccagattcaatgtaacatgaaggctccatttcagaggctgtacttccttttggcacttaacatgttgttgagcctttgtctacagtagtgggacttctcagttgatggtggatccagggaatggctatctggtgtgcagtatgaataaatgaaagtgtatttggtccttgtgtatactggaagagattgcattaacattgtcaacaagtatgggcattgagtttctgtacagacatctttctgggtgtaatgcagtagtgtttggcagcatgaatagattgggaggacaagactagcttttagattggatataataggctgcagctgctggaattcttattacccacctacaggaaatggaaaggccttgtgaaaggtgctttatgatgcagaacttgccagttcccccatgcatcttgattaaggttccttgtaatgagtgaaatatgtagtaaaagctgaatggagttgggctgtagttcagttggtacagtgcctgcttagcatgcctaagacctagtatcacataaattgagcatggcgacacaagcttgtcatctaactgggaggtagaatcggaaagtcagaagtgtaagattgtctttgactataaagttagagccgagatttttttttttgtttttttgttttttttgagacattgctttggaggtgtcctggaactaggctggcctcagactcacagagagcgcctgcctctgtctcctgagtgatggggttaaaggcgtgagccaccactgcccagcctttatgagattcttaaaataaacctaagaaaagctttgattgctgtattgactgagaatgtgtcttattctgtcacttaggctggctcctgaacttgtgatcctcttgcttctttctcctcagtcgtggttttacagcacagtgccacacttgaccacatatttaggtttttaaatgtgttcaggagttaatgcagactttagttgagaatgctaatctagccaggcatggtggtgcacaatcccagcgctgggaagcagaggcacagggatctataagagttccaaagccagcctgctctgcttggtgagttccaggctgtccaggaatacacagtgagacaatgtctcaagaaaaaaaaaaaaaaaaaaaaaaaaaaaaaaaaaaaaaaaannnnnnnnnnaacaatggtaatttagggctagtggggagggctcaggtgcttctgacaaatctcacctgagtttatttaccaagactcacatgttggaaggagagaaacaatctccacatgggtgccataggctgccttctcctaaataaacaaacatttagttggccatggtgtttcacacctatagatctggcattctaaaggctgaggcatatgagaattatcttaaatttgaggtcagtctaggttatgtagtgacttccagtccaggctgagctacataataagactgccccaaaatcaactgtgacaacagcaacccaaaaaatagcaacaaaaattctccttccagacagtaaactggacctggaatgatggctcagcattgtacttgctgtataatcttgaggactggtttttggattccagcacccatgtaacatgctggcactcctgggcacaccaggtaaccccagctctgagggacagaggcaggagctttggtgttttcctggcttcctttaaccaaggagacatgggccccacccaggttgtgagagattaactcctcctctggcttgttcatgccacacacctacactgtgcatgcacaagagcagtcaaacagacagtaactgaagaaatgaacatttaaagtaatgctagctttactaaaaacttgtgtagagatatgacagaaagtttaatctcttttacataatttacttgttggcctaatcctggtatttttctcaaggattttggtttttcgagacagggtttcttgtgtagctttggctgtcttgggtttctgtagaccatgttggcctcgaacacacacagaaccacctacttctacctctctgagtgctgggattaaaggtgtgtatcaccactgccctgctatttttctaaaatttaagatactgtataggagccaagcatagtgttgcatatgcctgtatgtaatctcttgactttgtaaattaaggatggagaaagaagagtttaagactgggctatgtagcaagatagctcaagaaagaaaataaggaaaatccagttaggcttagtggcacaatcctgtaataacagctactcagggcctaacaggagttcaaaggccttcttcattacagagtgagttcacagccaacctagggtatctgctttactatctatctatctagagatagccctggctgtcctggaattccttaagtaggcctctaacatcttatttacacagttctcctgcttctgtctctagagtgctgggattaaagtgggaaaggcatgtcctaccaggtctggcttcagtgtaggcaagacttggtctcaaaacaacaaaatgtaaaatggattgagagggatatatatatggtacagtgcttgctagcatgtgtgaggtcctagattcaatttctgttacaataaaaacaaaacacgaaagcaaaacatcaaaccaataccacaaactccaaatgagcatttaatagtgtgtcactgcacaatgctactaatatttaattgttataaataatacagaaggaaaccttaaaattttactagtccattttctcttttttttttctttttttcaagacagggcttctctgtgttgccttggctgtcctggaaccctctctgtagaccaggctggccttgaatttattgattaaaggtgcacaacaccatgcccagcccagaagtctgtttcccatctcccccctcctcccgttccctccctccctcaactcagggtgtcttcaaattctcctgaagaaaaagatacccttaatcctcttgcctctgcctctcaggtgctgggattatgaatgtgtgctcaccacacttggttaatcagtgtttctcaaagtaatacttagtgattgagagttctgtttgactgttgccttctaacatctgtgttagtattttagctgctgaaatccactgctttttttttttttttttttcttcctaggcaacagctgaacagatgcggctcgcacaagtgatctttgataagaatgattcagatttcgaagctaaagttaagcaggtatgtttctaggaaagtatgctatgactgtgtactttattttttagttaaaatattctgtggggctggagagatggctcagggttaagaacactgactgctcttccagaggacccactttcaattcccagcacccacatggcagctcacaactgtctgtaactccagttcctggagatctgacatcctcacagacattcatgaagacaaagcagcaatgcacacaaaataaacgtttgttttgtttgttttgtttctctgtaacaacagctctgactgtcctgggactcactttgtaaaccaggttggcctctgcctccctagtcctgggattaaaggtgtccaccaccaccacccagccgaaaaataaattatttaaaagaaatattttctttatgaattaatgtgttttgcctacattatgtatgtgcactgcatgcattcttgttatccagctataatgcatgcttaagttttcagatacaatactatgtctaggagagtagcttgtgtggggtgtaactaataagtttgtatgtgggatattctaatgcaattcatgaatggtggccatgtacaagtgaagtcccagttaatgttttaggaatcaaaactttgcaagttctatgctattgacctaagtttaaacatgatctaggagttctgagaatgttgtctgtgcatatgttgtgctgactagtaggctgggggttgtggtgcacacctttaatcccagcactagggagacggagataggctgatcactgtgtgtttgaggccagcctggtctatgtagcaaattgttccaggccagttgatttgtgggtgagtctactagttttattggggagtatgggaaagtcagcctgcacttagagcctagacttactggagtctaggaaaagctctcatgtgggaggacagcatgatgctgtatttgaatagaagaatcagcaaagttaatattgaatgccactttttggttccctttaatcatcttctgatactttgatagcttatggaagtgacaggaaaaaatcaggacgaaagcatagtggcccttcacgactgtaatggagatgtgaacaaagctatcaatgtgcttctagaaggagactcggacacagtaagtgttatttttcctcagtttcaccttgtatggaagttgttgtagaggggtcggggcgtgctgtgttttggagggggtgttctgggaaataaacctaggttcattcatatgtgagacaagcactacaggaaagttccagtaacttggtattccttcagcaaaacagtttctactaccctggcccttggacatgaacatcaacctaaattaccccagctcttggtactaacaccccctaaagtgccccagcttaaagtgctctggtttgtggatattaacaccacctagagtaccctggcctatggacattaacattgcctagaggaccctgtcctgtgtacactaacaccacctagagaaccccagcctttgggtactaacaccagctgaaaacccggctgcagactgctcacagtttctcatctcagttaccacctctaacctcctcccaccccctcattggtttttttacttttgctcaggatagtctcaaacttactctgaggatgacatggaaattcttaactgcctgcctcctcttcctttgtgctaggattagaggatccaccacaagactggggattaaaatggtgtgtgtgtgtgtgtgtgtgtgtgttatatgtgtttatgtatgtgtgtatgtacaccaggtaagtgataccctaggaatagagttttgggtttttataaactgccatgtacgtgctaggaactgaatccagattatctgcaaaaccaacttttttttttgagggggggttgttttgagacagggtttctctgtggctttggaggctgtcctggaactagttcttgtagaccagactggtcttgaactcagagatcctctgcctctgcctcccgagttctgggtaacaagtaacaagtacttttaaccactgagctatctctccagccccttctgacctactcacaactttagactaacagaaaaccagggtttgctgataacttctttattaatggatattccataagcatcttctcatgaggcttaaaatacagacacttataataatcacacagagaaaactgtaaaaggcggttatgaactttattccctttatctctatgttgaaattggattgtatttggtttgtatttctaaattgaggaacctatttcagggcaagttaaaacaaataatacttcacctaaaagaaagtttattgatgattgtacccaaaatgattttcttggttacagagttggcttggtggttaagaaacctgagttcagtttctagaaccctcctgtgttagttcacagtggcctgtaggtccagctctccttttctgaatgcatttacgtacacatgcacacatgcacaaaagcctgactttgttttaaaagatttatgtattttattctatgtgtataggtgttatctttgtatgtgtatatatgcactacttgcttgcctggtgcctgtgaaggccagaagtgggtgtcagatcctatgggactggagttatatactgttatgagctactactgctaggaatcagacagtacccttaggctgagctgtctctccagcccctatacacacatagttttaaaacaaatacatatagaaatatgtatatatttctttttgtcctttttgagatttgtttttagttttattgtgcacgcatgtgtgtgtgcgctcatgtgtgcgcacgcatccctacaaaggtctcagttgtcagattccctcagagctggatttacaggcagctggagccacccaatgtgggtgctgggaattgagccgtccctccaagttttgtctttttcaggaaagtagaactaaatataaaagaattaaaatgtagggtttgaaaggtgtatgacattgatgactgtagaactctttttgatagacatcatgggagactgtaggggggaagaagaagaattttggaaaagaaagctcagaaaacaaagaaaacagagagaagagaactgagagagaagcaagtcgtggacggggaagcagcaaccgaaaaggaagaggtggcaacagaggcagagagtgtgagtacagcttttctgcttagcatttccataccctcagagagctgaaaggacagcccagagaaagcccatgaatccatctgtacgtgtaaatttcctactgtaatcactaacagtggtctgttaggtgctgtgatggggtttcctgtgagtgctggcctgggctacaggtagttagttcattttttgcatcctttaagactggtttctggtctgggcagtagtagccatgcttttgatcccagaacttgggaggcagaggcatgaggatctctgagcctggtctacaaagctacacagaggaaactctgtccatgcaaaaccaaaccaaccaaccatccaaccaaataaaacaaaactggtttctgttagagatcaagtgaactggggttggagtgggtataggttcattcactgataaatgaactatttttttcttccccagttacagacactcatagtatagacgtggatcaaattaataataggtatgcctttaatcctaagcagagtcatatggatctttgtgtttgaagccatcctggtatacatcgtaagtcccagaccagccagggttatatagtgagacactgtctcccccctcaaacaaaacaaacaaacaaacaaaaacctaaaggagataaatttaataggcagggctttttatttagtttaacctccatttaaaaatagaactggtaaaaatagggctcagtaggtaaaggtacctgccatgcctgatgacctgagttcaatcccaggaaccatgtaggtagaaggcgagaaggggacaacccaaagttattgtccaagctccgcaatgtgtgccatggcatgtttcctgtggatccatattttgacaccattttacttggaacagcccaggagacattttataattagtttattccattgactgcttgtgtcgtgtggagacctatggtactgagaaaaacagatttttttaaaaagttgatagcctggtgatgcaccttatcctagaatttgagagcttttagtagggaaattgaattcagggcccagcctgaattcatagtgaattcctgtctcaatgcccctcccccctttttttcctagttctcataaaaataattagtttaagtaaattctccttcctccagcagtgaaattacagacacccatcactatgccttgctctaaatttttgtttttggcattaagtaaactcctcctcctcttctttagattggttccactatgtagaccaggctggccttgaattcacagagatttacctgcctctctctgtctcttgtgttgggattaaaggcatgcactaccactgaccatcagcctggttttaaatttgatttaaaaattacttttaatctatttattgtttttttgtggatacatatgccatggcacacatggaggtcaggaaacaccttcaggttgtcctctctctccttctaacatgtgggtcctggggttgaactcaggtcttcaggcttggcaggtgcctttacctattcagctatttcaccagccttatgtttttattttcctgtatttatttatttatttgtttttgtttttggagacagggtttctctgtggctttggaggctgttctggaactaggtcttgtagaccaagctggtctcaaactcagagatctgccagcctctacctcccgggtgctgtgattaaaggcgtgcactgccaccagccttatttttatgtgaaggttaattgagtggtagcattaagaatgagaagtatttatgcaatagaaatgtagaatttggtgatggggattgaatcaaagcccttagcttgaactcttctttagccacatctctatgtcttatatattactttattttattttactttttgactacatgactttactcatgtagccctgactggcctttgactcacagagctttgctagcccctgatacccaagttctgggattaaatgtatcatacctggccttatatgatactttaataatgtcacatagaacatgttatgtggggaaatacattcagaaagaggtggagattatgggaagggatatggtaaatttaaatgtactgcaaaggaagcctcactgggagctcatgtgagttaagtagcagctagagtgaagagagttaatgatgccaaaatctcttgtcaggttattttttttttatgtgcaaccatttaagccagtatgaatatgaaaaatgaaaaacagtagtctttgcttgcctctttctgggtagtaccttttttaaaaaaatttttttttaatttgaattagaaagattttcatgtcaatcccagttctttcccctcccctcttcccctgccccccccaactaataccctacctatcccaaatcctttctgctccccagggagggtgagggcttccgtagggggtcttcagagtctgtcatatcctttgggatactgcctgggggcaggggtctaggctcagggagtatccctcccaaagtccattcctatgctagggataagtactgatccactacaaggggccccatagatttccgaggtctcctcactgacacccacattcaggggttctggatcagttccatgctggtttcccagctgtcagtctggggaccaagagctnnnnnnnnnnnnnnnnnnnnnnnnnnnnnagacccgagctaacatggggttagctcgttaaacaacaataaagcctcatgcagtttgcatcaagtttctgcctccgcatggtgattggggtggccgctgttctgggctgagatcctggaggcctgagcttctgggggtcttgcaatataagtcagtcatcaatctcattatcggggaagagcatttaaggttgcttagattgttagttggtgtcatctttgtagctctccagacatttccctagtgcctgatttctctttaaacctataatgtctccctctatctgggtactaccttaaagaacctgtctctttgacattaccttttacaatgacactgcgtgtgtgcctgtgtttgctacgtgatattactgatttaaacacttttacagcctttaattaagaaataaattttgtgatgtgtaacatcgttgcataatgcgtgtttgttttgttcttactgtttaaaaaaatgtattttagataagggcacatccatgcagagaaagtaaaattactatgttatctattggatgtcttgttgctctatatgtagaccaggctggcctcacagagatcctgtttctatcccgagtgccgtcattaaaggcatgttccaccatgtccagcaccgtcttattttaatttaatttgtatatctgtgatatctggcatgtgttgccattcattttttttgtggacaccccccacctctctccgccctttgagactaagtctcactatgttatccaactggccttgaacttacgattctctttgttccaccatcctaatgatgaaagtgtttggtcttatgcttccagttttgtggtactttgtacttttttttttttttttttttaaagtatacagtattctgcctgcatgtgtccttcaggccagaagagggcaccagatcttattcaaggtggttgtgagccaccatgtggttgccgggaattgaactcaggacctttggaacaacagccagtgctcctaacctctgagccatccatctctccagccccttttcctagtttctaaatgttgtttacatcctaacctgctgttggagacacagtctcccttgtagaccaggctggccttcaacttgtgtgatcagaggagagtgcaaccatgcttcacatttttaactttttggtcattatgtgtttggttttgttaagtttaagtgcctgagaagtttggtacaaaggtttggaaatgaaaagttggcatttctgctttttcctctttagtcaagggtgaggagaatggaattgatagcaaccaaggagacaaaccttcagagcgaggcaagaggggccgaggcagaggtaagggagaatgatccaaatagaatgctgggcacgttattgttttgttttgttgtttgtttttttttttttttaattttactttggttctgttattttggtgttgaagattgagcccagtgcctatcctggataagaatgtgctccgctgctgagctacactccagaccctggcatcctattgcttattgcctcttggattctgaaaaccacttttatagtcaggtgtggtgggagtcaggcaggggctggagagttctagtatacatagactgtcaacaaagcaagaacagcttattctttattttgggcttttgtggagttttgcttgtttgtttttgttgtttctagacagggtttctctgtccacccctggctgtcctggatatgtagaccaggcttgaactcagatacacctgtctctgcccctccctctcaggttctgggattaaaccaccactgggcaatatttatttacaatgttttatgtgtatggatattttgcctgcatatatgtccatgtgctatgtgtatgcaggcctgtggatcccagaagagggctatggatgttcctggggactggtgtacagtggttgtgagctgccatgtgggagctggggatggaacacaggtcctttgaccagtgcccctaaccactggacccctctgtctagcacttgtcatttttactttttggtttttcgagactgggtttctctgtattaattgttctggctgtcctggaactcactgtttagagcagactggccttgaacttactgatctgcctgcctctatgtggattaaagtgccaacaataaaggggtgtttttgttttgttttgttttttaaagagtctcatactatagtctaggttggtttggaagtcactatgtagcccagattggcctgaaactctgcttgattaaatcattcaacaatatatacatatacaaatactactgtattccacaattgtgttttctaaaggatttggacgtggcagaggcagaggggcaggaaggttctctgctcaaagcatggggtaagtcacagccatcctattgttgtagttatttcctagttattctacttttctctccctccgacctgtctacaacttattgatcacacttagagcattaatgttgccagagatattaagtcagggttctaacctttgcactgctggcagttttacttggataatgctttattgggatgatagatttcctgcacaacctttcagtataacccctcacctccatgaagtcattaaaatgtctgcagacaactgccaaatgtcccctagggtagggatcaggcatatgtgcataattatcctgagttgccgagttgaaagccagctaaatccagccattgtacacaaaatatgttcttgtaaaaataatacttttatcctgagtgatagtagtaaaggctgactgttctaagtaggtgttacaattgactactattgtttctaggtttactctttctccttgtttttttgtgtgtggcaagacaactcagatattgagccctaaactttaaattggtagcttttatgtttacttcaaattcttctgtgtatattggaacattggtacttattttgttcttcgttaatcacctgatcatgatgccttggggatgttctgttagaacataattattttttacatttttatgtgtatatactgacatatatgctgtgtatttgtgaacatatgcatggcgtccgtatggagtcagaggataacttttgaaagtcatcctgtccttccaccatttgtgtcccataatagaatttagcttgccagtcttggcagctggtgccatctcaccagcccttcagttaggattgtttttgtttttttaaaccaaggcttttctttttttttttttctttaagatttttatttattatgtaaacaacattctgcttccatgtatatctgcacaccagaagagggcaccagatctcataacagatggttgggagccaccatgtggttgctgggaattgaactcaggacctctggaagagcagtcagtgctcttaacttctgagccatctctccagccccttcagttaggattgtcatgcaaatatagagaagtgatgaacaaaacatagctatagctgtacacgaagaagaatataattccattcaaagctaggttgggggtattggtgaaatggttcagtggttttcttggagaggccttgtgtttggttctagtaccccggtaccacattgtgcctcacaaccctttgaaccctagtttcaggggatctgatgcactcttctggcctccatgggcagggagcatgcgcatggtgcatatatgtgcatgtaggtgaaacacttgtacacataaaataaaaatgatggcacagacccatccttaatcctcagcacaccaaggcataggcagacagatctaagtctgtaagttcaaagtccccttagtctacatagcaagttctgggacagccacgtgacattgagagaccttatttcagaaaactgacctccccaaataaacctgccaagcttagagtccgacacaaggaaaaagagatgtattaactgttgatattactgctcattggagtttttttgtttttgtttttgttttttaaccattctaagaggtttattagtaaagagtgggaaatggagaggagggagtaggtacaggcctgtctggaagaaatacagggagagagagaaattggacggtttttaaaagatgatttttgtgtgagccttgagtattttatttgtgtaccatgtgcaggaaggtgcctgtgagacctgaagatgttttcctaggtactggagttcgcaggtcaatttgagttgttatgtgggtgctgggtattgaacctgctgccaagtcctacaaggagcagcaagtgcttttaaccactgagccatctctctaacaccttccttgacaatttttttcctggtgttctttcttggctggaaaagcttccaggtctcctaacttcttaggatgccaaggatcaaactgttgaaacctgagagccatttctacaggagtagatatagggtccagaagtagccatttctttgttagaagatatgcatgcttggctggagatgtagttggtttagtgccttcccagaaagccctgggttcagtccccatcatatcataaagctggacatgctggtacaaacttgtatttttatgaggtatccaccaaagaagattactcagacatgtgttcaagccaacagaaagtctttattagctagccagcaactactctaggtatttgagacaccttgcagccctgcgccttttcttaggttgagcttttttaagcataaaaaaacacatcctctcttggcatacatcagttagccagaagtggaaccacagaaagccaaaatcaaggtttgatggattagatcttattcttgttttggcaggtgttgcctatgtgctgggttccaaggcttgaatggtacttctattatggtatcatttgttttaaggtctgggggcctgttaacagtatcagaagttcaaggttgtcctcaattacagagtgagtttataggcaacctgggatacatgaggcagattctgtcttcaaaaatgataaaaaggagtggagcctcatgtctttagtcctactacttaggaggcagaggtaggttgagtcttgccagcactacatatccatagtgagaccctgtctcagaaacaaaattaaaacattcacatcattgggcctaacaggtaaaggtgcttgttgctaagacttgtgactaagtcctgtctctgagacccttatggtggaaggaaagaacctgctccccataagtatgcgatagcatgtgtgtgtgcccacacactaaataacagataaaaaaatctgtatcaggctgtttgtgttggcataagcctttaattccagcatttgagaggtaggcagatttctgtgagttcaaggctaccctagtttacttactcagttccaggacagccaaggctacattacaagactgtctcaaaacaaacaaaatcttcattataggggttggagagatggtttagcagttaaaaccactggttgcttatccagaggtacctgggtttgattcccagcacccaccagcagcagctcataaacatctgtaactctattttacagaagtcctggcctcttctgatttaaatgaaatccccattttctggcctctcagggcacttcaagtaggtggtgcatagataaaacacccatacacataaagttaaaaaaaaaaaaagtgtttaaagaagcaacatcacaatggcttaaaagttagctgtcatcaatcaaatggtaggagggagaagccttttacagcagccctttgaaggaacttgagcttatttggtttggatttttttttttttttcctctttttgtttttagagacagagcctttcaatgtttctttggctgtcctgatgcttacttttgcctccccagtgctgaactaaaggtttttcgagacagggtttctctgtgtaacagccctggctgtcctggaactcgctctggagaccaggctggccttgaacttctagagactcacctgcctttgtctcctaagtgctgggattaaaggagtgtgccaccaatgcccatcaaaatttttttgtatgggaaattttgtacacagtgtttattttgtgattttgatgcttgctttagttgcctgtttgtttacttcaaaccccaggacatttaaccctgcagactattcagagtccgcatctacagatatcaatgggacaaagtcgggggtttgtgctcagaatggtacagatgagggcactggtaagtgttttgatttgtctgaagtctttgttttgttctatgtctgttcttgagaaatgatctcactatatagcctgagttggctttgaactttcgtggtcctcctgtctcatattcttgaactctgggatttcaagacttaacgatctaacctgtcttcaaagactttttttgagagagagagagacagagacagactgactgactgactgactgtgagtttaggtgcctgtagaggagagaagagggtgccacattcctcgaatttctgggaattgaatgcaggtcctctggaagaacaaacatccttaactgccgctagagatggttttaaaatgttttgttttatttgagtatgatggggcatgacctgtctgaagttcctgaatccaagttgggtatatgtgcttaaccactgagccatctctctagtcctgcctttactttaaaaatgtgatgaagtcctgttttctacctgactttgaaccttcttatcttcttatctcagctgctgaagtgctagaatcaggtgtgtgcaaccactttcagctaggagaagagtttaggattttttatgtttattggtgtttttcatgcatgtatgtttgtgggaccacacttgtcagtgcttgagtaggccagccattggatcccctggacaggtgttggtacactgacatttaggagcttgggattgtactcaggtcttccagaagaacaggaactactcttaactgtagagccatctttcagtccttaggagaaaattttactgaaagtgcttagtattctgggtggtaactgttaaaaccttaaaaaaaaaaatgcgtgcgggctttatctatctatctatctatctatctatctatctatctatctatttattggggggcagttactctgtataacagtcctggatgacctggagacccacctgcctctactcgagtgtgccagcagtgactagctatttatttattttggtgtttttgagatagggtttctctgtgtagcccttgcgctgtcctggaacttgctctgtagaccaggctgtcttagagctcagaccgacttgcttctgcttcttgagtagctgggattaaaggcatgtgccaccatgctcagctttttgtattgttttctgaaatatgtaagtaaatagttgttactgtttgtttacctggagatcttctggagatgagtttgtggtagtcttaactactgaagctatgtttatataaaaatataatttatgcaaaaattagccactaatgacccaaaataaggaataccaaactaattcttcctccacacctggaactttagttgagggctataattctcctggtaacatttggacagtttcatagagctcttgcagcagcacttccatgttttcctgctccaatctggtttatgtggtactgggattgaacccagtctttgcacctgtgaggcagacaatccaccaactgaggtacattcccattcccaaacagaacatggaaagcaattgtaataacctcataaaatgtgatgcgcagttgtttgtcgtacctaatgcctcttaacagtatttaagaagctgatacaggaggattatgtaaattctaggccaacctgggctgtagtaagatcttgtctcaaaaatcacatcaaacaaacaggaaatatccaatgctaagtaataaatctaatggtaacaacagattaacaaacttgtatctagaaaaatacttttaaaacaggtaaaattggaagtgacattatggactttaaaaaaaaagaaaaacttatgtaactgggcagtggtggtgcacacctttaatctcagcactcaagagtcagaggcagggagatctcttgagttcgaggccagcctggtctacaaagctacacagagaaaccctgcctttaaaaaaaagaaaagaaaaaaacccttatgtttgtgaatatttttccttgtatgtctgtgcatcattgcatgcctggtgcccacagaggtcaggtgagggcattggcccactggtactggagtcgcagctggttgtgagcaccaggtgggtacttagcattgaatcgacatcctctacaggaacaagtgcttttaactacggcatgaattttccagatctaaagaacattttttaaatcctgttataaatttgaatttttaactggctcccatctttgcatttagtaatctatagtgatccttcttgtaaatgtctagtatctttaacaagttgaattgaaaaatatgatttattgaactgggcatggtagcacacacctttaatctcagcacttgggaggcagaggcagaaagatctctaagttcaagagcagccagggcttgaaataccatatcaagagcagactccccccccaaaaaaaatcagatttatatagttcagttggtagaatgcttacacagaacccttagtttgatactagtattgtttaatctgggctgggcatagtggtatatgcctagaatcccactacttagatacaggcaggaagatcaagttcaaagttatgctaggctgcacagcaaattgaaggtgagcctggtcatgagacactgactcaagaacagatttattagtaagtaatttatttgtttttgaggggaggcacagtattttttaagtgttattttgagggtcttactctacagtcaggctagcctgaatgtagtgcaggctggcctggagctcatggagattctcctgcctcaactcctttagccctggatttatcattttcagctttattatttatcttactaacttgtttgcatgtatgtgtgtgagcaaatgggtgtattcatggagatgaaggagagcatgtgagtccattctgttcaccaagtggatactggtgattgaactcagggttataaaccttgacagcaagaacctttacctgctgagccatcttgctgacccattgagatctaatttacatacaatttctacaggcagaataagttgaattctaacatgcatacagaattgtaaccataattaaaattgagatggtgtttttctagtagcaataaataattacaaataaactaaaaatggatcataatttaaaagcttgtagcatcttttgtggctggggatgtagctcagaggtagggcacttctttccatgtgcaaggcccagggatgtatccctagtattgaagaagtaaaatgtacataatgtatgtgaaagatttgtttgtggagaaattcaacacagtttctaccaaaaggggcaacatgtttagtgttctggagttggagatatcattattgctgcaacctggttttctcctcaggatgataggtattgataggtagcttcagaatagattctacttcacatcttagcagtcttctgccttcatcctaaaaacacaatggaagagtatttacagtaagccaagcaattgtgatgaaacaaccaagaactcaagaacttaatctcaaattatagtaataggcagcatggaactagcagaagtgtatatggagagttgacaatgtacctagcggggatcatgagtcttctgtctagctgactagagcaaaaattttacaattcagggttgttcactacagtgaatacagcagagcaacggtccaagtgaggcttacatgtattcacaaagaaggcaggaatgaatattacttcaggataggcaaagataatctcagtaagcatgagtcattaagtgtgtgtgtgtgtgtgtgtgtgtgtgtgtgtgtgtgtgtggtgtggattcttgtgcccatgtgtataactctagaaaccagaactgggcagggcaccatgtgtcttttattgctctctaacttttattgctctctaccttcatgagtgggtatgaagaggtcagaagactttctaccagtaggttccaggaatgaactcaggacatcaggcttaacagcaagcacctttactttcttagccattttgctggctccaatagtttgatttgtaaatcaggcatagtaagacatttaacagttagaacttactaaatgaagtaaaaactataagtgttatatgaatgttcttgatgttttgttcctagaattttccatttaatgtttttgggccgtgggctctccctgaaggggactgctgtgtgatacattaactttatttcaagtgctgactttctcttgtttccatcattaaaagctttccttttgatccacagaagggatgggaaagcctcacagtatatctcaggagctgccaaataaaaggtcttatggactcaaaggtatgatggatgttttgttttgaaattttgcgtagataagaatccttcagaaccaagtatgccatccattggtagagtggtcccccagggtacttgagatcccaggtttgaccccagcactgcataaagtaggtgtggtaccgagtacaggtagtgcaaagtttgaggctagactcaaaagaagaaacctgtgagccagtcaagtaatgctaaaggcatgagttcccaatcctgatgagtttaatcctggggacccatagatggagagaattaacctttacaaattgtcccctgacctccacattcatgctgtgacacctataacccatcctactcccaccacaaaataaataaaactaataaaattttgaaaacttaaagttgctccattcctatacaaagtaacgggtttcagactgagtgtagtgctgcactctttgaatctcagcactctgaaggcagaggcagatagatttctgagttcaaggccagcctagtctacagagggagttccaggacagccaaagctgtgtgataagaccctgtctcagaaaactaaaacagaaagaaagggaggggaagaaggagtgtgagggagggaggaaaggaggaaggaaggagattcattgtgtcatttttatagaacaactgtgtatttactttgttcttacttatctcttccctatggctctaccttatactccttgcttctgggcttttagtttttgacctgggactgaagccagagcattgcatatactgtgcaaatacctcaccagtgaactataatcttagttagctcaaccatactgtttgaaactgaaaataatgttatcaaagttatcccatgtgttttggggtataggaccatagataggaaattgaatcatttgtatgaaattcttactgtgaagtttgaatgttctagaattaagagtctgagctcagtccagctgtggtagattctagcactcaagaggtctgtgagttttgaggccaacttagtctacaaagcgagttccagagccgttacacagagaacccttgtctcaaaaaactggggggaaaaaaagagtctgagttcacctatttccatagcatttttatactacagtgtgtatggcaggctattgcagcatgtgcctctggctttcctatgcttttcttcacacatcaattcatggtgctacatctttcctacctacaactatcattatgcatgatgtcttcctgcttagaaacaaactcattttctcacctgattatgcacagcttctttgtgttaattttaaaattatttccctgctcctctggacttagaacaggatgacagttacagtaatgacattgtgtgaacttggttggaaattgtgtaatgtagcaattatttttttttaccttgcttcctatatctgataatcgctaaagtcactggtacaggttttcattacaaaggtgttctaattatatgttcatgtgggtatatatgcacaaatacacatgcatgcggaggctgaaatcaaatttgggtgtcatttcttaggagccatgcctgttgtgttttgagatgggctctctcacttaggttggggccttcagtagtctaaactggcctgcctgtgagcctcagggattttcctgtcatcacctctcaaagatcaaacatgtatctgcctgtttccgaacaccaactttggcttgatcatgctcagcttttacatgagttactggaaattcaagctctgttctccatgctccattctctagtactcgtcttacctgttcccatagcccttgaattcctccccccgcttttttttaacattatgcgttctgagaattgatctcaagttcttatacttccacagtgagcacttcattgactgctaactcactaactcctatagtttattattatttttattttatgtatttatttacttattttttagggggtttctaggcagggtttctctgtggctttggaggctgtcctagaactagttcttgtagaccaggctggtctggaactcacagagatccgcctgcctctgcctcctgagtgctgggattacagacatgtgccaccacctccctgtttaatttattattattttattattattattccagtattgagaaattaaaccttgtgcatgctagacaagcactgtatggttaagctgtaacctgccctaatgatccattttattcttttttttttatttatttgtttattagtatgcttgcattttcttacagcagaattgctaaaatatttcttaaagtgcagtttgaggcattaattttattttagtgtatatagttctgggtatttttatagagaattcattttttatttttattaagaatagatttaaggaaataatttttcttggattggtaattactaattactaattagttgaattagtaattagttgaattagtaaaattactaatgagttgaattatttttcttgcataatacacaaactcattagtgttgaagtttctttccagctaggtcactttgctgtttttcagccccaaataagtacacagagatatattaatcatcaaactgttggccgatggctagggcttcttaaaactatgtatgtatctatgtatctctacatggctttatcttaccagagaacacttggcacgtcctatcttcccagtctctacatggcgtctacttcctctctctccttctcatgcctatacttcctgcctggccaatcagtgttttattcatcaaccaataagaaaaacatatatacagaaggacatcccccatcacattagtagtatggttgactgtactggacctttttttattccctgtcaggtgcctggaaaaattctgtggaagaatggacaacagaagattggactgaagacgtaagtgttcattcagacctttcttcctcctgctatgtcttagcatctctcagaaaaagcccagtgccatttatcttgtctaacctgctgctactgctactacgcttctttcccctcctcccccctcctcttctgcctctgtcccttgttctcaaagagttgccttttcaacacatggttctcaggttttttttattgttgtttgtttctttgttgatgttatatgtgggcctgaatgtcctggaattctagaccagactgatcaaactcatggagatccttctgcctctgcctctcaagtgaactctgaaatgttgaagctgctcacctaagtcataatttaaacactctgtaactccccccacttgccccctatgcgtttcactgtgtggccctgggtgtcttggaacttgctttatagaccaggctggccacttgcctctgcctcctgagtgctgtgattaaaggcttaagatactggctgttttttaaaatcttttatttggtggtggtgaaagaaccgagcattcaagtgttaggtcaagggcaaacttggtaattgctgtctcaggcacacatgtgcaggcaaatattcaaataaaataaaaaatgaatctaaagataataagcccgtggctttcaaataaagattactaatcaatgaaagagaaaagacatttttctttggagaaaaaaaatcatcaaacttttcaaagtttcctgcttttttagcacattcattgatcagtggtgtttcaagtggagtactaactaatacttgaaggttggccccctttgtgttaagttgttccttcacgtctactgatgtagttgcctttcttggggagggttagttacttggtggtttttgtatgagtcatttcctttagacaccctctaggtgataagaacactgctgcctgaaaagggctccagtcaaatatgctttgcatatgtattgtacagacaaaagtaaagttttttctgttgaactttccatacagctttctgaaaccaaagttttcactgcctcgtctgttccagcagagaaccacatcacccctgggcaaaggtaaagggtttttgtgtttttctttttatcttctttttcattcgaagcataattgaaactttgttttagggcaactatttccatcttttattctactcttacagtttctgttttattcctctaattagcctttatttccccttattgcagcactcataacttcattcacatgttatcagtcgtgtccaatgattattgaatgacacttgttcttgggatatgttagcagttggccagagagtatactaaacctagttataattcatagttactcttttaataaagttttgattttgcccttgaatttggggtcttactttgtagcccaggctggtctagagcttagagatcttcctgcctctgcctctggagttctggatgtatatcactattcccgcctaaaacagtttaaagactaaactttagtaccttatattctttagtttcttcatgcatttgtttagatggtctctaacctaattcaaacttgccattttaaatggacatgttattataatgtgccaaattccagcaaaagaaggcctttgaggttaaaattatttgtgtgtgtgtgtgtgtgcgcgtgtgcgtgcgtgcagttgtgtagaggctgtgttgtccttcagaagggctgtctaccctggggggaaaaaacattgttttacatttatgtatttttatgtgtctgagcttgcatgtattttggtgcaagagcatcatgcccatgtgccatagcacttttgtgtacgaggacatttccataggcttacagacgtggttcaccatggtaattctaaacacctttgataatggtgataagggtctgtgtgactggctcctgcagcttgttctctgaccttaatataagcatgcaaacacatatgtgcacacatgctctaaaggtatttaattttaaaattaaaaacattttaaatgctaaaaagtttaaagcctagatatgtgtgtatatatatatctttaagaagtacaagagagctgggcagtggtggctcatgcctttaatcccagcccacctttaatcccagcactcaggaagcagaggcaggtggatctctgtgagttcgagaccagcctggtctacaagagctagttccaggatagcctccaaagcaatacagtgaaaccctaaccaaaaaacaaaaaacaaaacaaaacaaaaaaggaagccctgaatcttcttctcaaaaccaagctaaatgagacagggctttattataggagagaaaaagttcatagatcttcgttgagtttataactaagtgaaaaatagctaatttactggtggtactttaatttctcaaaaaaaaaaaataataattgagagctggagaggtggatcagtgggtaagagcacccaggttagattctatcactaacatgtctggtcatcggtctccatacttccaattccaagggatctgctaccctcttctgatctccatgggtgccaggcataaacatggcacacagatacatatacatagaaatgaaacactcatatgtaaaataaatgaatatgagaaaaagataattgagttaggcatgatgttgaatgtctttaattttaatattcaggatggggaggtagaaggatcaggagttttaagcaaggctcacatataaagtaaacgggaagctaaccttgactacctgaaaccttatgtttcaggtggtagtgcatgcacacctttcattccaccacttagaaagtagagaccagaggatctctgtgagtttgagaccagcttgatctataaagcgagttccaagatagccagagctgtaaccagagaaaccctctcttaaaaaatgtaccaaacaaaaatcccaaccaaaatcgcataaataaaaaatgcttaaaacaaacaaaaagaagccgtcgtcttcacaaattttcaacacagctaatcagatggcaccagggactgcaaactccactgctgccagtgacgattatccttagccactcacttttatttcagtgcgatgtgtgtttgagtttgtttgtttgtttgtttgtgtttgcgtttgttttattccagtgcgatgtgtgtttgcatttctttgtttgtaataataggtcctcactttgtaaccctctggctgtgttggaacctatgtatgcaaggttggccttgaactcaaagatccaactgcatcagcctctcaattgctgggattaaaggtgtggctcaccaagtgtaatgtacttcattcagtatggggtcttcaggagtacgcccattagcaagtcatgaagaatttattgctcataaattcttgcagtaatagctggaagtagaagacggtctttatccaggaaacaatgatgtgatggtttccaagcacatatctgatgattctgtgtggagctcagctactgagtttcctgggccgagatcaaacttctttactcatcagtgagcaataactggaatgaaagatttcttcttattcattgtgtgtatgtgcattttattttcattttgggttgtaggtgtgatgtgccaccacacatgagtggaggtcaaaggagagtttttgagccttgcttgtctccttccaccatgtgggtccctgcagttgaaatcaagtttgtcaggctttggtggcaggtatctttacttgatctctaagccatctcactggtcaaaaacctgaactttttgtagttcttttatttatttttgagacaggttctctctacacagtctggctgtccagaaagtaactgtagaccagagagctgcctgcctctgtctcgtgagtgtaaagggtgtgtgtcaccacaccaggctgtagtgctttcccagaaaaccctccagtactgtttctcacttgagtcttactaaccttttgaaatagaatttgctttgattctggtggtgttgcaagttttattattagcactatatgtgctaatatataatacaaatagcacaactatttgtatcactggaattggaatatcatacattagaacaccaacttaggttttagattattagcctcaaaattgaaattggtttcaggatagtaaaaatggttctgtataaggaacttgggctaggatcttcctctgtatgatttaactactcagaccctgtctcactggcatgatgagagtttcagttaagagttgttaggagtaagcctttgaaaggactcatggagtaccattcctgggtaaaccttttacagctcccacttaactgggtaagtcattcatgttgtacacagcatttatcccaaacttcattcttcctgaggccatcaaattggaatatttggtgggcttttgggcagggtaataggggcattataagatcttcgttgaactgggcagtatggttttccattcctttacaggcagatttgggagttcgaggccaacctgttgtacagagcaagttctaggccagggtggtggtggcgcaacctttggtccaagcacttggaaggcagaggcaggcagatctctgtgagttcgagaccagcctggtctacaagagctagttccaggacagcctccaaagccacagagaaaccctgtttcgaacacctcctctcccccacccccaccaaacaaaagaaaaaagacttaagcttctactatggttggatgtgatgttttaacaatattgaatcactctgtttcaagaatattgaagcctgggggtggtgccacacacttttaatcctagcactaaggaggcagaggcagggtgaactcttgagttagaggccagccagatatacatagtgatactctgtctcaaagcaaacaaaaaccaaaaagttgaaaggaaaagataatcatgaacccaagtaatggtgtctttaagagccattgcagctcctctggggatatcatcggaatttctcagtgcccatttctaagtcggttcactcactggctttgtaacctgtttggtgactactcagcttctcttttattttctctgaaactccatttccccatggttttccttattcaatctctggcttaaatttcctttatattgatgtgctccccagtttgctggctggtgccacttgctcatgacagctgattgctcgtttgtctctcatctgcttagcattgacctggtggccttgctccagaagcctgtccctcccactcaagccgcagaagccaactcctttgaaacatcccagcagcagggctttggccaagcacttgtcttcacaaattctcaacacagcaatcagacggcacaagggtctggcagctccacttctgccaactcctattctcctcagagactggtaactcacttttatttcaagttggggtcttcaggaatgtgcccattagccacagtcatgaagaatgtatggctcttaccttgcagttatttcctcatgtaaaatgctggcagtagatctttgtccaggaaacaatgatgtgatggtttccaagcacatatctgatgattccgtgtagagctgagctactgagtttcctgggccaagatcagaactcctttatgagtcctggtcagtgagtgataactgggatgaaggtatccttagtaatgattttgttttttaaagattttatttattattatgtatacaacattctgcttccatgtatatttgcacaccagaagagggcaccagatggttgtgagccaccatgtggttgctgggaattgaactcaggaaccctggaaagccagtccgtgctcttaacctctgagccatttctccagcaccttagtaatgatttttaaacttcctgtttgttgtgggtgtgcctgcaggtatgcctgcacaccatgacccacttcaagaggtcagagacaacttgtaaaagtcagttctcactctccactctgtgggccatcttgtcagcccaactgattattttcccctggttttgtttgaaaatatgtttctgtatttagtatgttttaaaatttttgtttgcaaattgaataaaaagcagatgtttgtcttgtctgtccaggtgttcctactttgcacttttcttctattccataaaatatactcctttttcagctggacgttggtggtgcatgcctttagtcccagcacttgggaggcagaggcaggcagatctctgtgagttcgagaccagccaggtctacaagagctagttccaggacagcctccaaagccacagagaaaccctgtcttgaaaaacaaaaacaaacaaacaaaaattacactcctttttcttaaattgtcaagtattatatgacagagtccctttcgatatgttttccttgaaataatgtcacccgctgttaggcaggcacagtgactgttacttctgagtgccttcacagtgagttcccatcaggaagaattctgggattggtagtgaataagactgacaggtggggcaacaagcttggagtgtcaccagtgaaggaatttagtacaggaagacagctgaagtctgttgtaatgcaaagtaaatacagagaatctgccagtgtgctttcctctgcttttccatttgctaatgacatatttctgacatctatagtttctgtttggtcacggaggtcacagatgaagctggaccacactttagtgagagcaagttagtattaaattagggttgtggctctaaacgttactactatttataacccctggtgaaattaagtaacaatttaacaataataatatagtaaaaatgggttaacataagacagaatgaatcagaatctgtggtattattaggacttggactctgtacatatgctcatttgtgtcttactggttcagttaagtaggtgaaattgaaactatactaagtgttacagagagcaaatcagtggctgttgagaaaaagagtatttggtaatagtagctgctgggtggatggtggatgctgtgtcagtgagactagtgcttgagaaagatgggtttgagtggggcctcgatggcaaagtaacatttgcacaaatgcactaagaggtcagactgtgaaagatgggcctcagcagcccatgacctagtgtgttttgctcacagtggagagctctgaattttctaactaagctattccacatcttagaatactgataatagccaggcatgatggtgcacaccttttaatcccagtaccagagaggcagaggcagtcagtgagtttgaggacagcctggtctatagagagaattccaggacagccagggctacacagaggaaccctgtcacaaaaccaaagaatattgataataaaccaaagaatattgataatatccatcccctctggaggaggggatcattagtttttttgtttttttgtttttttgttttttttgttttttttttttggtttgtttttggttttttttgttgttgttgttgttgttttctttccctttcttgtggagaatgattggtgttcctagtcatctgaacaacctgagcacagtactgttggcatttactctgcttcctgcgtgtctcagtgtctgttattaactatgagcttttgatgtctacttcaatttaatgtttcaggaagcactcagcactgacctctgctgttcctgtcattagagataattactgtttgcagtttaggaaaagtttgtgttttggtctatcaagcatatttttgtcattagttgtttgtttcttaaaagtttattttatggttggagagaaggcccagcagataaaagcagttactgctcttgcagaggatccaagtttgattcccagcacccatgaattaaaaataataaattagtactaataaataaaataattatttttttaagaagactgtaataaatgcttttgtcctcttaacctcacatcaggaccagggaggaatgctgcatagtctagtactgttttttaaagcaaggtttgcttgttcagatgatccaagatgcagtgttcttacttctgaagaccactgtgtttgcaagcctgaagggaaagaaagctaagagcttgtgctgtttctgtgtctttacagtcatctgtcctgggctcagggtttggagaattggccccatcaaagatggtgaatatctccagctcccagattttggacaagttgaaagcaccaagtttgaattcgtttgctgccacttcaactgcaccgcagagcagtacaagtccaccagccactactgcttcttgggatctaaagccctcagcatcccagtcctcggtcctcaatcattttggtaagtatatgttttctgagctggtttattgtactgagtcagttagcagggcatgttttatgtgaacagtatggtggaacaactaaattaattgtctcattgtacagtgcctccatttgtttattgtacacaattcacaggaatatatagcttcctagctagaagagaagagcaaaaatgctgcatggtaattaatgcctggaattccaacacccaggagttggagggaggaggatcaccataagcttgagaccaacttagtatagagtaagaacctgttgcaaaagccaagcaacagcctctttgggctggcttgttacatgcctttgatcatcatcagtttgagcccagttgctctgcatttcaggactatactttcaaaaaaaaaaatgtcatgcccccccccaacaaaaacaacaacaacaacaacaacaaaaaaacagctggaaaaccaagcaattgggactagagaagtgaattatcgagtcctggttgatctttcagaggacctagcttggaacccaccatccacatgaccacaaaaccttatgtagctccagtttcaggtattctggtgcctttttctaaccttcatgggtacatccacatgatacacagatatgcttgtaggtaaacacctatgcacataaaaagtgtaattactgggttggagagatggctcagaggttaagagcactgactcctcttcataggacccgagttcaatttccaacacctacatggtagctcacaaccatctgtaatgaggtctggtgccctcttctggcatgcaagcatacattcagatagaacattgaataaataataaataaataaataaaacctttaaaaacaagtataataaattaagcaagtagttgctcaaatgaaaagacaaaaggtaagtgaatgcatggtaggggaatctaagtggtagtttgcaactcttaaatacagacatagatagcacttttgagttcttaatgtggaaagtcagtgaaatcactttctcagggttttggggtgcagctcagaagtagagtgtttggctgctgagtgaagccctgggttttaaccacacactacaaaggaaaagaaagtccacaagagctatgatgcacccccattctgccattttgctgtatccatcatgatttggtcaagctttatttttccattgtaaagggagcatgcatatacttgatgttttagtcctgtttcccagctatactcctgtgaatgcttgtgtgagggaatagtccgggttggtagaggggggatttttacatggttgcttttatgcttatcatcatcaataggcagaattctctgcttcctgaaatgacttgccatgctcaaagtaatctttgtgaaggctattaattacttcaactctattggaagctggattcataggcactctgcctgacagagagcattaattacagatttgctgaaagaaaacagatgttgagcatgaaccagggtgtttgtatagacattctaaacacaacaggcactcttattagttcatgtgttgacacttggtgcctaccatatagaaacattgatgttgaatctaaccaacattcaaacacactattcagataatagatataagcttctgctgttagcgtcctcccataatttataagtaagtttatgaataaaagtaggttgtttccatgttctctgtgaagcctgtgttttttgctacctgtctcattgtaattgaacatgaacttacttaaataagatgtgctgtttttattttattattttaaacagtgctatgttgcccaggctggcttttaacttaacaatactcctgccttggcctctgttcttatgagattacaggcatgcatcctaacactcaggtacttggcatttctttactgttttctttttttgtttttcttttttttgttttgttttgtttttgttgtcaccccccccagggtttctttgtgtaaccctggctgttttggaacttgctctgtagaccaggctgtcctctaactcagaggtccacctgcctctgcctcccacatgctgggattaaaggtgtgcaccaccaccaccaccaccaccaccgccacctcctagcagtttgcatttcatttctatgatttctgtttcctgaaattagaagtgttttttgtgttttttgttttgttttttatttttatttttttaattacaattggaggtggacagtggtggttcatgcctttaatcttagcacttctgaggcagaggcaggcagataatttgaattcaaggccagcctggcctacaaagtgacttccaagacagcgaaggcagcacagagaaactgtgtctcaccaaaaaaaaaaaaaaaggtagaaagaaagaaagattgcaattggcatgttctaatagttgattttattgtatggagaaaagagtcgtgtgttcattcattaccatcttgtttttcatagctcatccatataatacgagtatgaaaaaatagactgtatatgctgagttcagtgccctaaaggtgagggaagatgctgtgtgtacattaaaatggagcagcctatgaaaagaaaatgaagatatataaattatgtctgtgtggttttgatagtcaagaacccaggtacaaagttgcttctctagagcaaaaatgagaacagcaatggaaagagttgtgtttgtcacacatgttccttatagttttatattacacataatatatagtaatcaaaatagtttttttagaggcatgtaccaaatcgatggctgtggagatggctcaatttgtaaatgcccactgtgtaaggaggaacatctgtctgtggctgttcacccacatcaacattgggtgcaatggcacacatctgtgatcctagcactgaggaggcctacagtttaattctggagctcactgcctcgatgaatgatgagttcctccaggtccagtgagagaccttgtctcaacaaaaaaaggtagaaaggcactctgggaagcaattagtgatgacccctgcctacacacagagaatacagaaaaattgaaaatataataagcatctacaataacaaacaggtgtgtgtaatacttccatagatatttctacttcatgtcccctcttcatgaaaaataaggaacaaactattcaggcaccaagtgtgtatttgttttcctgttcttccagcaccatactatttactcttttcaagtagatggttcagaacctagtagtaatagaagcctcctgaaactaaaggtatagaagtccaggtgtgttgcagaattactcattgccgcttaacttttccttccacatttcatagacttcaaatctcagcccgagccatccccagttcttagccagttgagccagcgacagcaacatcagaccccggcagtcagtgttcctcctcctggtttggagtcctttgcttcccaggcaaaacaccgagagtcaacacctggagatggtccttctgtcaacagacttttgcagcttcccaacatggctgttgaaaatattgtatctgcccaccaaccacagcccaaacacatgaaactccctaagcgccggatacctccagcatctaaggtaagcattccatgatgaattccatgccaaagggtttatttcacactaacgcaagtatcagaaaactgagtattagacattgggatacagtgccttcaaccatagctcatcatcatcgcttgggaggatttggccatttttcaggcactaggctaattattagagagagtgcagtcaggccgggagacagagcctcttagttcaagtacagacctgagggtctaattgaaaggaagcacttttgttattgtgttggtatctcacagtttggaggtgtgtgattacctgactagataataccttcatcactgctgtgtccctgaaaatagctgaatgtcctcatctactagctaccgttacatcccccaacaactctaaagctacttaatttataatattaacatggaccattcctctacaaaccaataagttgtttgctcgctttccctcactatttaaaaggttctgtttctccccctccctcccctttcccactgtttttgccattgcagcccatggaagccacttgcttgagcctgttgtaagccttaaggcctggagccctggcctctcttcctaacagctttgctttactaggttcccgcttccgcagtggaaatgcctggttctgcagatgtcacagggttaaatgttcagtttggagcactggaatttggatcagaaccatctctttctgattttggatcaacaacttcagccagtgaaaaaaataatcagatgcctatcagcttgtacccgaagtctttaaggtacaaacctcacattttagtttgacaggatatagtcctttctttgcaaagtaaaacaaaacagagtgtaagaaattggtgaagacaatctaataaaggttttgtgcagctctcaacatgtttagcttcacaaactctgctatgcactcctttttcttgctccttccctctgacaaagtgtgtgtcagaactgtctgatcaacatatgtcatgcaagctgaatcctgcaaaatgtggcttttgtatcccttagctttcatttaagctttcagaggtcatccatcatggcttctattgccatccatttcactgagcaaatgtggccgggtcatagttggtagacatataggctttttttctctctttatgggtggtgaatggtattgccgtgttacaatgtttcttgtagcccgataactgagttgtgtgataagcacctggctgtggtcgtactttacactcccccaggagtctacaaggacctagcttctgcacagctttccaacacttcagtgaaaccttttgcaagtagaaagatttgagatttttattagtaggtttttccatgtctagagggaaaacctgttaaattatagactgtagtgcagctttgtagttaatgtgatactgagctggcctggttagtgaagctgtcatatgccagtgtgtgcctaactaacatagtgtactctttccagtgaccctttgaatgcctctttaccaatgaccagtgctgtacagaactccacctacacaacttcagtcattacctcctccagtctgaccagctcgtccttgagctccactagtccagtaacaacgtcttcctcttatgaccagagttctgtacataccaggattgcataccaaagctctgctaacccaccggattcagctccaggctctgttgctgtaagtggttctcctgggtttcttttcttaggatgcacactttagccaattacactttaaaattaatttattagtcaggcaaacacctttaatcccagcattatgaggtagaggcaggtggatctctgaattcaaggccagcctagtctacagagtaggttccaggacagccatgactaaagagaaactatgtctccaaaatgtgatgggggaggggtggtaagacgtcaagagacaacttgtaggagttctctatctagtgttgagaggatctaacactgggtgtcagacttggcatctggtgtctttgctcatagagccatgttgcttgtccatcatagtgtttgagggaaaggaccttgcttttattaaagcaatgaatcaatgaatagtacttttctaccccactgtcacattctaaagtgacattaactacaaagctgcatgtatatagtttttgtttttgtcttttcttttcttttctttttttttttttttttttttttttttttgtgtgtgtgtgtgtgtgtgtgtgtgtgtgtgtgtgtgtgtgacaggatttctttgtgtaactgccctagctggtctggaactagctctgtaggcccctcccgccttagtctcatagagatccacctgcctctgcccctgctggggttaaaggtgttcaccaccacccggccagcctctagtaccagatgtacactaccagaagtgttgcctgtggaacactcatcaaatctaatcagaaaagcattggttattctcataagaggcttatcgttgttaaccagtgggttcttctagtctggattgttgtattcaaggtccatagctaagtaagacttgttttaggggccttggggaccctcctggccaagaactgtaggatagggtatccagcttccaggactggggtttttgtttactaagctattgcttctaagaatagcttgatgcatgagtactggaaatctccattcaaaaaaactgaagcatcattctattaagaatttgagggggactggagggatggctcagggcttagcactgactgttcttccagaggtcctgagttcaattcccagcaaccacatggtggctcacaaccatctgtaatgggatctggtgccctcttctggcaagcactgtatacatgataaataaataaatctttaaaaaaaaaagaatttgagagaaaaacaccagggcaaagcaaggtctagatcttggcagttgctggtcagcagatagagaagaatgagggagaggttggcaagcagctgtggataggaatctctagagaagtggtatgaagcccagcatgtctcaagctggctgtgatgggtctccccagaactgcaatgatagcctgtgagccaccatgtggatgctggccatcaaatacagactccctggaagagcagccagccccctttctgctgtgtcatcattctagtcctagttggacattttaatatagagtgcatcagcttttccctgttgttactttattctggagatggtgtcttagcctcgtgggctctgcttttgagtgcacattctgtggcttcctccccagcctgtgagggcaggtgccattttattgttttagtcagtcccaccacagtgtcttaggtggagtcaagccagttgacttaggttctacaatttgtggagagcatagtcacaacccactctgtcttaaggtcacagctcatcttttcttagaaatagtcctcaatgtgatgcttcctggtatggaagttactctttctttaaaaaggaggttgactttttttttttttaatttagaaacttacctttgcattacagaatttacatgtgaaatgggaagcctcacatgacttaattataatgagacttcatcttccttattcagtttaacaacctgatagctgttttagaagtggtttatcctcctgtgtctttgttacttccctgaattctgaatctgttttcaaaatgcccacttcttgcgatttattaaagttagttgtattttgtcttctttttattttcattttccttttatattagaaaaggaatgaaacagatacgggatggagatgttcggttgtaagagcctgtcctgctcttgcagccacctccggcacatgacacccacctggtacctgagtgacgtgcactcacatagatgatgcacatacacatgagtaaagtctttgaaaagaaataattctcctttgttaacctgtgcatatgggtgttatagtcccaattcagagttaccctggtgattgtctggaaatgtccatgtgttaactctctctctgttctttgtagaatggacatggtggtggccgaagtcagcatacagtagacagtaagtgttatattttcattacaactggtgaaaaccaactggggaaagagtggctaacataattcagaaaacaccaattgagcagtggttaattctccaaaatcagtacttgaccttttccctggaaacccctttttgtttgtttttgagattgtctcactagtagctctgattgacctagcttggcttgctatgtagaccatgctggcctcaaactcacaatacctttgcttgcctctgcttcctgagttcctgaattaaagatgtataccaccataccacacctcagagctactttttctgagggggtgttttagtcactgtgtatcccaggctgactttccagttactaagatgtgaagttatctggggatctcagtgtgcatgtaggaagctaccgtcttgagccattctcactctcccttcctgctccttttctaagggaacattctctgggagtcttttgtgaagtcacccttaggctgtggaagtgacctatatatagcatcttaatttggggtgagatgcttcaccagagtcttcatccagtttctttcagaaccaacttcattttcagaatcagacactagctgggtgttggtgacgcacatctttaatccagagcttgggaggcagagaaaggccggcagatctctgtgagttcgaggccagcctggtgtagagagcgagtactaggacaggctcccagagctacacagagaaaccctgtcttggggaaaaaaaaaacagaaccagactttaaaagtcttaggagtgtgaattcactgcaaacccacctcccccaaccctatcctttagtttcctagcaattatgcaaggattggcaccattcctctcctaatttccctatgtaacacaaggtatttcactccaaactggttgtcctttttgattttcaagtcagggtttctctgtgtagccctggctgtcctggaacccagagagccttgcctctgcctcccaagtgccaagactaaagttgtgtgccaccactgcctgacaaacccataaccacagtcctcttacaaaaccaaaacaaacaaaaaagactcaaaaagaaaaaacaaaaactacaccccattattaattctattccacacttacatattactcaaagataacctaatcatctttttcactatcctatcatatcatattagaggctgaaatggcttcaactagacccaactgggaaaaattaaagcctactcctccatttcccacacagagtgctgctcttccatacaatccaactcatactccttagcccaataattaatatcctaacaacttcagtattccctttgtttttactcattgatattacttccctctcacaaatatgaattaaaatacccattacactatttatagcctctacagtcctatgtctaatttatgtccccacactcactatcgttctagcaaccaacagtaaaatatttaatattagcttggtcaatagactacctccctagcctatatatagctctgagttcagtctctaggaccacatgcaatcaggagtgctggaaggcatgagaatcaaaaggtcatcagtgtggtggtatgtgtgaatgcttcaattccagcattcaagaggtggtggcagaaggattaggagttcaaggttggcctgtgctacatgagtctctgtctcagaaagaaaccaagttggccaagctgcaggccagcctgccccctgcccactgtcaactcttcttgttagagtggagtgcttcctctcagggagctctgcaggagggaagagacgatgatgtgtttccaagcacatatctgacttatgtgcggatgacaatcaagctgagtcttttccacggtcatcagttttatctgtgacatctctgacacaaagacttgtatctgtgctctgtgattaactttttgaaacatataccaaggaagtttccgctgtgcatctgcaagcagatgttggtgtgaattcttactgcagttcatgaacagatttccacatttcccctgaagttccagtgcactctggcagcctggacctttactggcttcaagtggatggaaatgctctgaggaggtctttcttctctctcagctcttccctccctcaagctgtgctttgtaagggatatttgtctcactacatacacgtctgctttggcccgtcttgtcttttctgggtgctggtgccacgtgtcagaaaatgggagaaatatgtccacatcatgacagtttgtttgggtgtcacacgtggttatatagtcctgtctgcaagaagtggagctgcctggtgacatgcttaggctctatcctaggaaaatgttacatgtcatatagcatatctgaatgtgaccagataccgaatatgtctccagtaccaagggttgcttctgaggctaaagagatatgtttcttgcagctacttcatctgttccagctccaaagacgacagatcctccagccctcccatctgtgggctccctacccaacaccacctcctgcactgcacttctgccctcttcatcccagcacactgccactttgccctccttgtcccagtctggtgacctgtccagcaatgccctttctcagcttagcaggtacgtgggtgacagtgagaataagaaaggggatggagacttgtagggctcctatcagatgagaagtgtcatatagactttggttgtgctacacttgtttagactttggcctggtcacatcccagcatcagtagatacgaaaatcctaactgcgtctaatgtttctgctgcagagcctgaggtctgctgagaagcagtgagaacataagcagatacttaaggacttgcttgtccttagtttttgccctgtaccacttgaatgtgtgtctgccttaacgtctgtcctgattccagagatagactactgggataggataaaggaaagggagttagcttgttccccatgcttcctggtagaactcagaacaaacgtggttggttgatttgaactctggatctgatgagaatttaagctggactcttaggtgtgggctaaatagaaactctcttgactctcagtcttctgagctctccagctatgcaatcctggttttattctttttatagccaaaatggttataacttgttgaagccaggatgtatcagatgtcatggtgtatggccctgtagaccatttttgaccaacaggatgactttgtcacatgattctaggggcatcgtcagtgattggattgaccttgattatagcctgttaaaccaggtaagtcagacttccaggaacaaacttgctgacatgtggtactcctttttatcttctagttctctctccagccaccagaacagcttgtcctctccacatacagcgcgccccacaagcacgccccacactgtaagtgcccacacttcctgcactgtatacccagatctcccatgagttggttaattttgatctgagatgacccagagtctcctggttcattgccttagaccttgtgtgctttttcctcacacagatgtcggggctgtgcttgcttcaaggacttagggtgctcttttccctgcagggacagttttgtttcttgccctttttttatttcacaattttttgttgttgttgttattgaagaataggtttgtttctgtttcccgggtctcactgtcctgccttgtggcctaaaaaaaagatacaactaaattgcattcttttgtgttgatgtcattaggactttactaatggtggtgattaggtgtccactttgattgaccttcataccaaattgcctgctaagagacagtgtgagaaaagatgtttttagaaggtcaagaaatctaggctagtggagattcaaagtggagatgtcagcccacatttatgttcactcacatttatggatgtgcactgtgtttttccctgttgcccacacaagtcaggaagagggtttcagatattctcgctttatagctatgcatgattttgagataccaggtgtgtgctagggaccaaatctaggtcctctgcaagcttttaattactgaaccaccatctaaagttcctttcttcttatttatgtatgtgcaactgtttgtgtctgtgtctgtgtgtgactgcaggaaccatagagtctaggaaagggtgttggatcccctggagttgacatgacagttggttgtgggccctctgatatgggtgctgtgtagtggtagtgggatattggcagagacactccccctctagaagagctatgtgcgctcttaaccactggggtttctgtttgagacagtccatggaactcccaaagatccccttgcttctgtctctgaagatgtgtgttatcatgaccagcctccagcccagctttagtagtctggacggtaagtcatggtggctgaatctggccgtacagctagaggctgcactgaccctaagacagggcatctcactcatcttacagccgctgagcaatggcatggctcactgcctggtgagctgtaggagttctttctagctgtcccagctccgtctttcttgctatcaaatccacatgtattggcttttgttttgccagcatgccagtgtggagagcaccccatcctcagccaccttctcaacagctgcaacctctgccccaagtgccccatccacgggggtcgtcttgcctgggagcagtctgtgtctgggtgggaccacagtgagtgtgcccagcaacagtacccgggccacagcgttggtgacctcaggtatgtgcgccaagtcccttacctatctcctcaacgtaaacttccagacctgttccagacctgtacctccacctccacctccacctccacctccacctccacctccacctccaagcagctgagctgcctcacagtgaagtgggtaatctcttgtgtttggtttttcctctttataggcaaagcacccccaaacctgcctcagggggtgcctcctctgctacataatcagtacctcgtgggccctggaggactgcttcctgcttacccggtgagcacatagtagaactcctgattgcctcagggcctgatacattgcaggacttggtaaggggttgtgagttaggacagggctgcccacctgaggcagctcatctccctgtctctgtccacctaatacccaatgtgtcttcctccttctagactctatgtagacatgatctgtagcgcctgacccaagtcccattcctcagtgtgtctgctttggtgtgtgtggtctctaatgtatctgtgactctcctgaagatctatggatatgatgagctttggtgtgtgtggtctctaatgtacctgtgactctcctgcagatctatggatatgatgagctccagatgctgcagtcgaggctgccaatggtgagtacaaaatggcagcccagactctcagctctgctccttaacctgctcgactgccaccacagttggccttctggaccccagctatgggactctcccacactaccactgagaagctgtgtctggtggtgatatgcatggtttgacctgggggaggggaggcagacatatagggagcagtgctcatccccaggagaatttgagagactttagaccacgagcacatgtgaaccatgtcctgtaccaaatgtagtcccttattttcctgctccttttttttatattttcttcttttttaagaaaactaaaaatagctgaacatggaggtccgttcctgtaatcccagcatttgagaggctaaacttgagttagaccaacttaggctatatgttgagatcctgtctcagaagaaacaactatcacacagtcatgagagttgtacttggaaatataatgcagtcttcatctcagggcactggtgtttctttgggctgtagtggccaatggctgccctcatgactgctctcatgctcttctctctgtaggagaatgaggggcggggcttgactgactttattaaactgtcatatgggtttagcctttcacctttatttagaagaacgctgtccctggtgtcattgccttactttcagccagggttgtctgttctgaccctgagtctagggataaaatgatgggtcttataggagagccagtgttgagcagagaaccggagtggcccactcctcatgaagcaggattaccctctggttagccagtctcagcctggtgttttgtagagcatcagtcagtgacagacacagaatgtagacctcaacccaagcatggggctgcctgttcttcctccaggctcactccttctctacacacacccctgtcacatggttgctggccaggccacccagagtgaacagctggagggtcatctcctctccatctgttgaagtccttttcagagccagaggctgcctgaggacctgctgctgggtctaataggacttggaagaagttcctgggtagaatccaagtgtggcctgatgacactcaacagatggctttatcctgtgttaggtgttcttcttggctctccacgcacacccatgggtctccattttttaatttcctgtgtatgcgtgtttcgcctgcatgtatgtaggtgcaccatatatgtgcctggtgcccatagggtggaagaggacatcagatctctggaactggtggcagttgtgaactgccatgtgggttactgcaaaagcagccagttctcttaacctttgagccatctctccagccctttttctttttaaaagttttgtcttagaggacatctgcagtgagctcacagtagaaacagctttaaatttttccttggagcatattccagcctttcttggatttccttgttttatgtgaaagggtactcccttctgggtttcctccccccagtctccatttgggtttctgcaagctctttgcagttttctgtgcctcttggaattctggctgagaattccatgttttcctggtgtttaccaagacttgcagccaaagggttccagtgccactcccagctgagatgctcctgtctggcttggactcagaactagggcagctcagaatcctgggtagtaggggccagggcaggatttcgacctctataaagtataacccctttttactttttgtagctctgtgcagtgtcattgttgccagggctaaatgaattgggagagactaggctagttaggacctagacctgaggtcctgtacctggctctgcttcctgccccttctacgtttccagtggctcttcacttagtctcacagtagagagcagtcaagttggtttgatctgtactgtttaccaagtctccatatgtgttgtaaagataggtgtgagattggctctgtctgatgcaagcattaagatttgcagtctgtccataccttgtcagttgaaacgggggctctgagttgcacaccgagggtattgtcacattggagctctctggtacagctgcccaccatggtcacacagagtgtggcatcacccggagtgcccatgcttgttctgccagctgggtctgctctctgtgagggtgggacagatgatttgctcagtgaatctccttggtcttttctaggattactatggaattccctttgcagcacccacagcccttgccagccgagatgggagtttagctaataatccgtattcaggttagtttgctcagtgggcaagagtgggaagagatgggctggcctggagctagcaattggaggccagaaaggctgaggtgcttgaaggtatgagtcctgagctggcagttcctgttcgtgtttgtaacagccatcctggttcttctaggtgataccacaaagtttggccgaggagactctgcatcccctgcacctccaacgacaccagctcaggcacagcagagccaatctcagacccaccacacggcacagcagccctttttgaatcctgctctgccacctggctacagctatactggcctcccctattacacaggcgtgcccagtgccttccagtatgggcccactatgtttgtgagtatttctgcagggtgctccctgggctgtggcttcctcaaaggttgaaaccctggacatattttccagcgtctgtcagttacatctggccttcaggattgctcaggggtcagagtccattccccagctgccttcagatccctaatggattgcattcatgaaaagactgattctcttggttgtgacttggttttgtctgaggctgcctgatctcctctttgccttattctgacacactcaaacctcacctgcttgtcccactaggtcccgccaacctcggccaagcagcatggtgtgaccctcaacacaccccctaccccttttcagcaggccagtggctatgggcaacacacttacagcacaggtaagggcataccccctgcactgaggggcacagggtaggacagacttgcttagccaacacatgcctctttcttgtaccctgccatgctaggttatgatgatttgacccaggggacagcggcaggagactacaccaagggtggctatggtggatcatcacaggcaccaaacaagtcagctggatctgggcctggcaaaggtagtgtcaggtcctcacctgtaatagttgtctcctatctgactctgaggcagggctaccctgccagtctttggaactggcactgaatgctgtggggaacaactgttttttgtcctaggagtatcagtgtcttcaggcaccactggcctaccggatatgactggttctgtctataacaagacacaggtgagggtatacaaaggtgggcaggtagttggggagtggggagacatcagttcagcctggccttctcattgtcatctttgccctacagacgtttgacaagcagggatttcacgcagggacacccccacctttcagcctgccctctgccttgggctccactgggcccctggcccctggagcagcccctggttatgcgcccgcaccgttcctgcatctcatgcctgcccaccagcagccccacgcccagctgctacaccaccaccttccacaggacagcccggtgagcgcagggatggaggcagcctgcctgccctgggcctggggttgtgtgctacccattatagccttttctcctcttcctcctcagagtggctctgctcagcgcaaccagcccagctccctgcagcccaagactcaagcctccaaacccacctatggcaactctccgtactggacaaactagaccctgaaaacaagagggtgggctcttgtgcaggagagaacacgtggagcacatttctgggagcccggtgccctttcctagaattctgagacataactgtcagctgagcctctgtgggaagcctgcctcccagacccactgttgtatgtaatgtatttatgtatgtatttgtaaatgtgatagaagcctggagggactggggtgtggctactgggcagcatacaagtgtgctgtccccatctggacatcctcactgtagccaagtccacccctcccccccccttctgcctctaggccttccacgtggctcccagctcaggagctgtctggtgtgccactaaagggatggtggtttggggactggggtcaggtaccaatgaagaatcacgacttttctttatctcgctccctgtgaaatattgtttcttccttctgtaattacttcatacttgttgagaaactgatccttttgtcatttgtcatggtcccccttctaacaaatcttcagctgggaatagcagagatgatgcctgcacagcagggccttctgcttttggtctggtcctgccctaggggcttgcctttgaccaaccatttaaagaagaatctgaactgggtctcagagatgttcagcccgtcagctcccttagaaagaaatcaaagatctgcttccatctcagtgaaagcctgtctccaaacaaaggctcctctataccagttgtcccaaaccaggtgggcaactgcttcagggttttctctcacccaaactccacctaataaagttcttgagagca

SEQ ID NO: 6 - DNA, 51421 bp, Cricetulus griseus
  misc_feature (32411)..(32421): n is a, c, g, or t
ttaatgtgttaagagccattgacatttgaagatcatcagaagtgaagataaaagatctcaaaaattataatgtaagtgaatgggaaactacaaaaattggacagaaattaatattgccaataataacctttggaatcctatattaccccaaatgaaatttgttcatatgagtaatcagtaacttcaaacgttagtgccatgttccagtccagaacatccttttgtctggggaaagcagtcattaagttttagtcacccagtaattttccattggggtatgcgggtgcctctgtgtacttcctcccttttcttctctaggactttgaagtttgatgtgagaacaggatgaatagggaacaaattatatttatgtggagagtttgttttctggcagcagatacatacatacagatacatagataaccattttgtgtgtcttagtcataaagagtaagctgtttcctcccttcccaccttctcctttcatcccttcatttctctctgatctgttgagtattcactatgtctgtttatgatatgggctagatcctacatttttcccctcctgagacagggcttaatgtagcccagcctggcttcaaactcactttgcagcttagtgtggacatgacttctgatcctcttgcttctttctaccactcgagtacgaggactacagaagattgttgcacttgagtttggaaattcttcagaccaaactgtgggctttttaaatgccaggcaagctctctaccaattagtttccttaattcttgatagcttggtgctatgacagctatattactgttaggtacatcaggaccactcagtgcttttcagatgctctggagacctgcacattctagttcaggtggtgtttggtgaacatgtggtttgcagtttctagccattctgaaacacagggaacagatccaagaatctgtactgaatgaagtctgagaaccatcagttcagatgctttttggagtcctagtccaactccaagagtttgaagatgagggaaaggcattgggaagtttatttatccaaagacacagttaatttttggaggctgggaaaagttaagtgttttttctttgaagccttcacaggtcatgttgtatgttttgtttggctagacagccttgctatgcttagtgtttataagcccttcctccatctcacatactagtatcataaccagtccaccattgtacctggaaaaacctagaagcctgaagatcacagtttctgagtctttagccagatgtatggctgattgtgactttgaaataatcattgggtaatagtttgggtggagaaagagcactttttttgtaggtcagactttcatagtcttgtctggattgaggttctatgcttctgacgatctgacttcttttcgtagagtctgtaagtgggaagtatgggctagctgtgttgtgagcagctctgttcattgtttttctccccttgggctctgtgaagcacagtgttaggagttgttgagttaactgtttatggagccacagatacagccattgatattaactcatatttgtaatattttgtaacagtatatttgtaatactttggtatttattgaaaactctaaggaatattttgaaccatatgttttgacttaattttattactttacatattttatatcgtgtcttatagttcttgagttgtaccttgtattcatagatgaagtttacccagttaaaaaaaaataccctgttatgttggaaacatgaaaaagttggattatataatgttactactcagtttctgagtgttttgatatatgtcttaaaggatgcttttcagatgttaataatttgcttttgtgatgtgggaaccaagctgaagcttgaagttgctcaaagtgcttcttgtaagttgttgttcacctctgcacacatattatcattggcttcatagatcccaattcattatcattggttttgtaaactataggctcaaatttgcaaatagatcatctctcaaagggaacttagtctgggagtatagctcattggtaaaaccaatgttaggcattcccaggttcagtccccagcatcataaaggaaaaagaaagaaaaatgggactttattatgtaatgttaattcccttccaaagacatttacttaagtaatttcatacatgcagaaagatacttcagaatgacactatatttctaggataacctgggaaatgtttgaaaaactagaatgtcatagttttaatgtaactgctacctatggagttgccttgttaattatagatgtttgccattgatttagtttaaaatcagaatgaaaaatgtatacattgatcagttgaacctgtttcttacttcttgtgctcagattttgttaagtatttaagtatgtgttattaaagtaatctttacacaagtacctaaatttctctttcattgtgtaagagtctgtgatggttaatgtcacttggtaagatctaaaatcccctgagaaatgggtacctgacatgcctgtggggagttatcttgattttgttattccatgtgggaagacccatttaaatagaggttgggaccattgtctgagcaggggagccttgtctacaaaatggagaaagtgagctgcgctctagtgcattcatctctgcttcttgactctggatgtgagtaaccagcctattgctgggactgtgcagccttgatggacatgtccctgagctgtgacttcttcaagtcgcttttgtcaggcctcttctgacagcaacagaagacactgaagcagaatcttactgataagttcaggttgtcaccttcactacttcaaatactcaacagtactatattggaagacttcttccagcaaatcttcatgaaagaaaatgattagcaaataaataaatgaatattcactcatctattcagtgtaatcacagaagctaataagcatgcaatttgtattttatggtttctcaggagagcccttattatcatgatagatacagactcagaattttccagtgtccctgctaataaaagatggaactggaatttggattttcgtataagtgtgctgttgattttttactcccaatataaattatagcgtggaagtggtaaaaagttcttgggatgtacattttgctgattaaaggaaatttcttctgttggaaagttgatgataggctcatcttgtccagtcagttccattaaagtctaactacaaagatctcatttcacctaatccttctctttctctgtattcatttaaaactacttcaaaaacataaaaaagacattcctcagtcctgtcataaaaataaagagaaaatgaaaaaagctagaagtaatgactctatggcctgttatttgtggcaaccaaccagaaatgtaagtatgtagggaaccgtgttcaaaagtatggatgcacaccattgtcgtgtaggaatccatgaatggtaactcaggtatcaactagtccaggctaggaagaggatggagaatgggttgtgttttcttagtgctttggcttagtgataggaaatgagcagtaaaacccaattccacttcctcatcgtcacccagactttgaagtctgtgtggaaagttaagttaattggaaggactgtgatttgtgcagtaatagtagcgtttgtcctgggaaaggacctgcttagtttaaggcatgacacccattcatttaacagtgaattcacatatgcaagtagcatgagaagattatacaaaagtcatttattaagacacagatgggggctggtgagatggctcaggtaagagcacttgttgctcttgcagaggactcaggttcagttgtcagcacctatatggcagtttacaaccattgtaactctggttccaggagatccaaaaccttctgacctctgcaggcactaggcatgcatatggtgtacagacacacatgcaggtaaaacattcacacaaaataaacaactgtaagaatagtcttagtgggtatgtgttgttctgtgcttgccgagatcagagtgttgcccagatcaaagctttactgactaaggtgactaccagttcaggctttaggtatcttgagttacaatctgaaaaattcagtttaaaatatttctctcagttaactcatgtgtaaggaacttttcctgtaggcagcttgtgagtccacttaagtactaacttaaggtgctctctttaatacaaataataaaatagaattggaggagttattttaggacttctgtgactgtggggacaggcccggtgttggtgctagtgctggtgctcagcccttgttgctggccccacccacctcctgttgacagtcactttgattacagtgctttggtgtttgccagttctgttactgtggggaaaacaagtcttgcaggctgttaccagtataaattggttgttcagatttatgttggaattaacaggtcacatgcactgaattgatctggaaataaaatgataccaatgtaaccgtgtgttctagatgatctgttcttacttccttggaattttccaaagtgccagccggtgtcagccaaggctgtctgagctcaggtccactttgttctctgaatgaagattgatttctgtcatcagacacggtgataacacaaggtttgtgtcacctctattgtccttcagattggttacatttaaacatgtagagcaagctggagagatggcttagccgttaaatgctaggctcacaaccaaaaatataaacatggtagagcttgcacggtgtttgaaaacgaattaaaaatgtacagtactgtgttctggtgaagttgttttctgttttggagacagatattctgacagtaagttttttgtgttgcagaacacactgcaggccttttattatttaagtaaaaatttcaacagaatgactaacaagcataagcacacacaatgcttaggaaggacactagtccattgtgtgagtgttgagtgcaaaatttgcattcctagaaaatctttctcccaatcacaatacagaacacattctttaatatccgtgggcagcagcattaataacaagaaaacactctcaaaaaagtacctcttcttttcatgggatactcaacaaaaattgaattggtagtgagagaatctgtttaaacaaggcaagtggtttagatcttactgcagcagctgtggtcagctgagcctgggagtggaagaaacatggcttatcctgaaccctcttgagacttgtttatgaggagtgtgaaacacaggtgacatgactctaacttccgtgctgttttgagttaagaatgtgtgatgttagttacatttctagtatctctaattttcgattttataagaagtgtttttattgactttaggaatagtgggttaggaggaattaggggcatgaatgttggaatctgttagtgcttgggttttagtttctgtttattattgttgagtgctgacaaggattttattaacaatccagcagaccagtatgtcagagacagtactttgccattgctttcattaaaaaatactggtggtagacttgactttgtgtttgaagattggattagtgttattgaatagattgaaagttgtgcatggagtgtgtgtgtgtgtgtgtgtgtgtgtgtgtattttttaaaagttcccctagtatttatactctattataaggttgagttttggccagaaagattttgagtttagaaacttgtcagttttatattgtacatgaagacactttacagtgaagataggcttttaggtccaactggttgatttcctctctatttttaatggttccttatttatgatttcatttgttactcttctgatatggtgctcttgtatttccacaatgctgttggtgaacacttcctactagttcaatattaaacaatacttttatatagtatcaacattttataaagaatgagcttagattaagttgattaaatatatttgtctggtgtgaaaccaagattctttgactgaaagctcatgtttcagccactgggttctctgtctgtgtttcatgttttccttggtgaaccttccttctcacatttggctatgatgaggtgtgagagtgtcaaactagcacctcggttagcctgccagtctaacctactttgtacaatacatgatacacaacagcatttgttggttatgtagcaaaaagaaaaggaaagtgatttaagaaattcctgcttcctcaaatggagaagagggagagtaggagggcagttagctgaccctgccattccttagactccatttttctacaaagctgaggtggtgccttgaggtatggggatgtttgaggtggtgtgtgaaacctgctgtctgcagacattattgtttctttagcagcattaacaaaggatgcttctaggtctggtaatgtgtcagtacttctgtgggcactcagaggtgccaacattcatttgcttagcaggaattttcttaatttgcaagtttgcatctttagtcacttcaaaagaaaccccagaaaagtaggttctttaacttttgatactgttttgaaaaggacagagtaattcctgtctgtctgctgatacctggcctgtgttactgttcacatcagtgctgcactttgtggtagtagaagttttgaataggacagcaaaggaagagggcattgtggtaccacagtagatgagtagctgtatgagaatgactgagtcagatgacagggttctgtctggttctcgtggtgcgtgaagcactgccactgacagagcgcagggatggctggggatggagactgagtgctctcgctgttctgtgccctccttttttgtatatgtgcgttctgttctttcagagctatatgggattcatggagaaataagcattcaaataataccagctttattctttttatgtaggaatttggaagagtgtaatttgggctagaaagggaagagaatcttggattgacttccattttttagagtaatgatgagaatttagataaatgcattctcccaggccagtacacaaccattaagttacaccccagctgtttgtgagttgttaatggtcttctttaatacagtacagtaaaattgtaatgctgttgtgaggggtagttctcataggaaaaactgtccacctgaataatgtaaagtgtaatggacatcttggacagtgctggttatattctgaccagttttgctgtaatgcttcatcagtttctaagatttgtgctgcttatgcttcctgtgttgacctaactttactttatgcttcctgtgttgacctaactttactttctgaagagaggcattaatgctcgggggcatggagtgttgtgatcactcctgttgcacagcatagttgactctgtgttgttttgaatcttactaatatttacatgttatacagtgccttagaagttgctagttagggctttgagctttgtcagtatatgtttaataagtatgtgtatgtgtgtatgcttgtgtgttgtgtttatgtgtgtctatttgtgtatgtatttgtgtttatacatatgttgtgtttatgtgtatatatttgtttatatgtatttgcatttatgtatgtttgtgtttatatgtgtgttttatgtgtgtatatttatatgtgtatatgtgtatatgtgtgtgttcctattgaaagatatataggaatagaagattgtgattttaattttagttcataactctgcttcctggctcaggcaaaaaggcccacactaatcaggaataaaaaacaaataatgctgagggtcaaggctagcatttttcaaatgtttacatttgtgtgtatgtgcacagactgggagaggagagttggggactatttttgctctcaggagtggaagagttattaaacctagcttaacaaaatgatttcagtgtttgtaacagtagctctcagttcctgtcagtcttgagtcttatagtctccctctgctgacactgattatgggaactcttctgttttcttccttgatttttctttattttgagacagcatttcattaattctattagcaggctagaagttgctacctttccttgcttcctaagccttagggggcctgtccttccacatcctgccaactctggttcttggtgtttcggttgtgggcttagcctttcacaaacggatgagccatctctctatccctaactccgtttctttaaggatcagattggtagactttcacccattttaactttccacttctgtactgaactccattgtggtcaactgaggttttctaatggttagatgtccttttctagcctccgttaagtaaaataacagttggcatggtattgtttgtgaggaaatgtgctaagctgttagatgtattattgtattcatcattataagtatatgaatagctcttagcattgctaagtactcagtaggtattaactaatttatccaataagtttaaataaaattaaacctatgagtgtctatcatatgccagctattatcatagagctaggctagtgtttatcatctttcaagaaaattattaccctcctaaggaatgttttggcacatttctctgtcctatcccctcttcctcatgctcacacagtgggtatgattttatctactgtgtttgggaattaaaataataaaattttcactgattgtgttagtatatgcttgcaatgccagtacatgagcagtggagatagaagagtcagggattcaagactagcttgggctacataaaactttatctcagaaaccaaaataacatttaaaatttgttgttggtttttttttttttttttggccctacctcagtgggccattttattcacacccatggggctcatattctcccattgggaatgtgtgttctggattctggggatcccataatgatcagtatcgataggatgtggaatccttaaaggtttacacttaaaagaatgtgggacacagaaaataaacacataagacacacgtgatgctgtaggaaggaaggaaggaaggaaggaaggaaggaaggaaggaaggaaagaaggttgttaatgatacattttaaatatgaactgactgtgagcagaagttcaaaaaaggccaaagggaaaaccaggaatgtttgcaagaaaagagtcatcaggagtggtacccaacggtgcctgcagggaagccatagagcaactaggagatgaggtcaggacagcagcagatagcgagacaatgcataggtcgtttgttttaagggcttcacttaccctagcattgacatgggaaggcttaggaaagttgaggagagatgaatgatgatgttggttgctgtgttaagagtgaatggaagtgcagaggcaaggcatgtgttttaggaactccttcaggagggaaatgatacactagcagaagagctgtgtcacagtgattagagaatgcatgtgtttcgaaggccaaagacgttcttgagaaaaaagtgaaaaatgtctgggtggtggtggcacatgcctttaatcccagcacttgggaggcagaggcaggcagatctctatgagtttgaggacagcctggtctacagagcgagtgccaggacaggctccaaagctacacaaagaaaccctcttcttgaaagaaaaaaaagtgaaaaacaattcaagtttttggttggaggaagcagaaacaagcatagagttagctttgggggtctgtggaggcacttaaataagtaatttgttgaaatctgagtctagggaggtctagagttgacctggaagtcagggttccctcatgtagaggtggcagtgttgaaaggcccagtgaaattattaaggagggttatcagtgtcctggacaggagcagttctattggtataataaaagccctaatgaagtggggttaagagagaaatcttgctctgtaacacaaggtggactgcaagggctttaaaaggcctaggctaggtaagaagccatgattcaggctgaatccaggctttgtgattgagaagttttctttgggttcatttggttatgtggctataggtgtggaatagcagagagctggattttatgagtttttggaattaggactaggtgttgttggatatagttcagtctagttctcagagtctgagacaggagggttcgaatagggggaagccagcctgggctgcatatcagcactatctgtcaaagggaggaaggaggaaattgagaatattagagtcgtggtgatcctggagcaacgtctttgagaaatgagagtttagctatgatctcaacagggatggtttgcatgatgtgggtttaggtcagtccactccctaggcccagacacagaggagaggtgtaggaaagtagagaagtcactcatttgtgtgtgtgtgtgtgtgtgagagagagagagagagagagagagagagagagagagagagagagagagagagagagttgggtgtgtgttatgaagttgtgtccttagggcaaaatctggcattaggaggcataatagatgaagaggccatttaggaagagctatagtgaatacagagtttgtgtaagaagcatgttcaagcccaggaggatgctcattccccttcagtttcatctctgtcagaagcagagaaagccaggtagaagagaccagcttctgtggcagatgtgtgtatatttcagccactcatttgttactctgtctgtaaatgcattctgtggcgctcatgtactggctgaattgttgactaactgatgcatatacctgattttaaaggaaatatttagaacagtatttgatggaatactcgttcggtacaaggtagtgttattacatgatgtaggcagtagccaggcagcctcagactgaggagtcaggctagagaagtgtaagtggcacttgggatagaaaggtggaaagtgacttcagaaaactcatctgtgttaaggaggaactagaggagaatccagaggaagatgtgacagaaccagcaaatcttaatggcaacagaagaagcgtggctagaagacatgtgacagggtgtcactgacagtcaggttgaggtattcatgttgagttcctactaaatgactagcgttacaagtctgtaatacatgtgcgtgcttcctccatgtaaaggagactagaagaggacaggttgaagagcattggagggaaaactgaccttgtgtctgaggacatttcatcatctgagatgggaaggaagagttggtttgaatgaaaggaattcactagggtggggtaggaagttgaatccagccacccctcagcacctgtttccagtcctgtcagcttagtgttttcaacgagtaacagactgtggtggcagagtaatcgataggacatcttttattgatactgggttttctgttttatttgacgactctgtaatattagctaatgctgtgtacttattttaaaactgttttggcttgtactaaactgattttccatctctgattattatttttaacttttatttctcgtctgtacaccagtagatatatagttgtatttactaaataccaaatcctttctctactccttggatcagtataatttaatggattagacttagtcactatccagctttctccatggagtaatagctttctgcttatttagtgagcagatcaatttgagtagttttgcaagaaccccaccttcagtggcatcagcattttatatatattctttttgcattccctatctgtttaaccacttgttttttctgtgactcttgtgtgtcataatatggacctttctggttgtctattaagtaacttcctgataaaccaaaattcttccagaatttttccagcttaaacctttctcagtcacatttaatgcatccttctctgtgcacctgtagcacttgtttttaaagttactcttagagcatagttaaataagtatctgcatcgctggtgcctgttccttaatagcacatctaatactgaactctgtgcatctttacagtgggaagtcatgaataagtcagcatcaagtaaatggataagtaacacatgcacaaatgcatagaaagtaagctctgagcccctctgcctcctggtacatatggcagcacacatcagctccatctgaaaaattcctagactgaatccaccagctacacacatgattcagtttgttatcatggcggagactctgagccttaggtacctggtataagtctcacaagccccaggtgtgctaaccctacatgttgtcaacactgctgctgattgttctcaaagggtgctgacaacaaaaagttaagagccactactgctgtctaatagaaaaagatttttcatagtgacattggagggactggacttgagtatgttgaccaaagacattgctgtcaagtaagagcttgctactaacttctcagttacttcccttgaagcttactgatcggagtagtaccacagattgtttaaggattatttgtccttctctctgtctttttctgtgtagccctgctgtccaggaacttgctctgtagataaggctgacctcggacacacagagatctaatcctcttgcctctgcctcccaatttctgggattaaaggatacaccaccactgcctggctatttgtccttctcttcggtctagcatctttttgtttttggtttttgtttttttgttttttttttctagacagggtttctctgtgtagctttggagcctattctggcactcgctctggagaccaggctggcctcaaactcacagagattcccttgcctctgcctcccgagtgctgggattaaaggtgtgcgccaccaatgcctggccaggctagcatcttaaaggaagtgtttgctctagtgtcttaaggaacctttgcctgggagtgcatacaaaggactccagaaagcacaaaccttccttttctttcaccctccacgtttcctcaagtttctgttttattttatctgtgcatcctcatcattgcttctaaaagagtttgatttgaatcatccattcttttgatctttattctttcacttgtgtatttatccaacaaggactttgcaagtatctgctcaatgccagttgcatgtgagagtctagggacagaatggggtaactaacattcttctttcttgacatttcccttccttcttgaaatttgcaatcttatgatatgtagccaattattaaacacttgccaagctatataggagcagattaggataagtggaaagaaagaaaacatgaagtaccgtgagcttgctctgtgggtcccacatccaatagcattcctgaggaggaagtgatgtcccaccagccagctcccaaataataacacagagacttcttattatgacagctcagcctatagcttaggcttgtacctaactagctcttataacataaattaacccatttatattaatctgcattctatcatgttgcattgcctctctgtttactctctttgtctcccaagtgcctagattcttcctcatcttcctttctctccttggaaatcccttctatacctcatgtgtagctatttggctgttcagctttttagtacaccagtcatagcaatcaatatactttcacacaatgtacaaataccccacaatatttcctcctttttatctaaataaaaagaaaggttttaactctagcaggaaagctatatacaataagaacaattatcaagtaagaattacatccacaatgtttagtccatatatatttggcaaatttggagaaagtgctgtatttatactatcttagtgagtccaaagttttatgcctaaaccattttcaaccgtaacatgtattaccatcctggaagtatctttttagaactaaaaatatcttcttagataaacaagatattatgtttctcacccttataaacttttcatctcttatgtaaatttttttttctgaatttggtaacaaggaaaactctataactgtctcatcttcaattccatcagagactggagaaatatacaatactatctgagtaaacgggaactgcagagcaagcagcttccaaaacagtataaatgacagagacatctggatgcctggacagtcatccaaggttcctctgcaacattggggcatccatcttcagcctgcaggcctacaatatctgacaaactttactgtaaagcccagcgttatcttggcaaagctcagcagcctttttcctttgtgaccagtttggacagtatattgtcagcagtcaggcaagggcagtttcttacccaaatggctaactttgccatattgaaggcaaactctatatggagtttcctcaatgcctatcatcctattatgtagtagattgatgctgctaggagcagatgtttttcactatcataaaaagccttgtgttattaaaacattttaaatgccatattctgtaggtctttgaagtgtttgaagaccatttatttaaaatatatctgaccttgaaagcatatctaatatgactataagtttgattgttatagataactaactaataacctgtcttttgttgttatcctaaatagctttcaaggactaagactttacattgcctttttaaaagagctgtgtaggcatattaccttaaacaagaatagaaacatatacagtataacaataactttaaatttgtatcaatatacaaaaatatctttaaaaagagtagaaatatatatagagtatgttctgacaaaagcaaccttaaatttgtatcagtatatacaattccataccagtgtaaaatatttgagattaatagttgctttttagttaaaagtagattcaataattcacccctttattctttcattcctatattccttttttctttttagaaagatcattgcatccaatctcccttgcttagtttcctcccttaccatgaccagtaacaatttgtaaccaacctccctaaacaatgaaaaacatccataaatcactggatgaccagaaaccacccatcccacctcttgggaatgtgggcttcatgttctttaagctgcttcctgttgtctggggctgatggcatcttcaggggatcctaagaatgttgggataatggtcaagtcctgagaaagctagctgtatttttttttttaactttgtttagtctgtgtgatgggaaagttgtagagcttatctgaagttttggctgtagtctgtgaggctggaccatctcagctagcagctttgaagatgttcttggtgcagaattttgaggaaactgtaacagaggcgttctgaggggctggatcacttgggctagttgtctttattagtgtctagtccttcatctttttctaaaaatacacaaaacttttaaaggttatacatctgtgttagcacagtatggaatgtgcagtgtgcacaagtcagctaaagatgattttttgttctatttttgaacagataaagggtatttgttagctttataagtctgtttggactgtataaccaaacctccatccatgtcatatgaaagaacggcatgtaataataagtcatgaggattctgtagccaacaagatttagcatgtctcatccagtcttaagagctgttcccataatagagggatcacctttgtctttcttggctttttcctttatgtctttagccaagatcctcaggaggtcacccaccccactcccacccccatcgaatctgatcccgattatctttgtggaaataaaagcacaacctcttccccaatgcaaccattgtccaacttccattttgaagtcaagacatccctaaaatatataagctggattaatttagcagttccttccaaaatccagagtgtctcagcagctgtcggtctctgttcattagcattcaaaaaattaaagttaacaaagtgccgtacatgatccagacaccctgtatttcccatttttatatgttttccttttatattaccttactctctctttaaagactttgttacttttaaactattttttctatgaccattctcttttctttgacatccaagtacatttttaagcacactatacctgtccagaggttttcttgatctgtgcctgacttttgcacatctacagtgttttgtgatggcattagccaaaccttaaactgctgtcggcatctctctctcgggttcccccacgagcttagctttctgcctgtgggggctgtgtttaccgccccagctctgggaatttgttgtatgtgcctgaactacgagtttgtacccagtgccagctgctcaggtgctctgctgcacagccacacatctgcatactaagcctacctaagaaactgcagtcacccggaagctgtacttttttttttttttttttttttttttgtgaagctttcttaggccttatgtggttatatgtggtcccatgttgggcaccatattatgtaacaagtccttttctatcctgtcagtcagctcccaaataatggcatggagacttcttactaattatgaaagcttggcctatagcttaggcttattcccaacaagctcttagaacttaaattaacccaattatattaatctacattctaccacatggcattacctttcttctctcttgcacctcctctttcctctccatgtcttctggcatcatcaatgtgcctagattcttccacctcttcctctctccccagaaatcccatgtatacctcttgcttagctattggcctttcagctttttattacaccagtcacaacaatataccttcacacagtgtacaaacaccctacaactggtgacatttcaggcgagagctgaaattgaagatggtgcctgaaggaaccatgctgcctgaggaagtctgtcttatttaaggatcacagggaagacttgtttgttggactggggagaacaggggagatggatacacacagaaagttggagaagtctggggtcaattagctcatgtagtgagaaatttgtggtaagactttgttgctgttatttgctattttggggctaagagattactgtataacccaggttggcctcaggtctgtggtaatcctgcttcagcttccttatgcctaaaattagaagctgaatcagtacaacggcctcataaaatgatttaagctagagaatgacatggtttatttctacctttttactattgtgaataatgatgctgtaacatttatgtaccatttgtatctgtttgtgtgtcttgtgaggccatattttcatttcttttagggctatctttggaggtcatagtgtgtcttagtttcatttctgttgctgtgatacacactgcccaaaagcaacttagggaggaaaggtttatttggcttacaattccaggttatagtctgttattgagagtaagtcaaggcaaaaattaaagagcagctagtctcatcatgtcttcacttaagagcagagagaaatgaatgaaccaagctgtctatttgccactatgtaggctcaacaacttcttcacttttacagagttcaggaaccagcctaaggaatggtacttcgcacagtaagactggctggacccccatcatttagcagttaaaacaaacccacatagacatgttcataggctagcctgatctaggcagtttctcaactgagttctctgttcaagttgtgggtagttgacagaactaacctatagtgggaaattaccaatacggagtcagatagaaatataagggtatttaatagggaaaagccttacttacagagcgacctagccagccggcgtggtagcagtctgtacagcaagtaccaaagtgaaactgaaagagcaaacgcaatcacaccacgtcactctgaccacgccctcacaagcgtggtcaggcacacctgaggccagtccctaagtaggagtggctacagcttcccctacactaaccattatgtagacttactccaatttgtccatcaaaagtgactgtaccattttgcattccactcaggaatgtttgagtactagtttctctacattttgccaatatattatgtcctgttgtgtgaacagaaaatagacacataatttgcagtagtctaaggatggggtgttgaattaagactaagagcatctcactgcagtaacatgtccagataatatggaagtagatctacaggactttagagtgatgaggtgagattggtattccagctagtttatatccacttgacacaggctggcatcattgtaaagagaaaatgtccctaccagattggcttgtgcacaaacctgtgacacatcttcttgagtgatgataaatatgagaggtcctaactcattgtgggtggtgccattcctgggcaagtggctctgggttgtaaaggaagcaggttgagcaagccatgaggagcacccctccatgacttctgcatcagcttctgcctccagtttcttgctttgaattcctatcctgatttccctcagtgatagaatgtgacctgaaaattgtaaaatgagatgaactttttccaacccaagttgcttctagccatggtgttttataacagcaatagaaaccctaactggtagaacagcttgtagaacagaagtagagaaaagatagttttggttttcagaaatcacttgggacttggaattgtgttttgacactactcatagttctagatgagttttacatgaagtcaatgtcatgatatctttcactgacagctaagctttaagatgcctgtgaaaatgtcatataactgattacactacagagctgtaaaccggtgaaaatgtaaagttaggggttaacatagcttcaggttacaagaggatattgagggtttgccaaaacaaagtagaaaatgaatgctcttgagttcagtttggatagaaaggggaagtgagacaggcaagggagagcagtggattagaagaatggaagggttgagggactggtgtctgtatggggctgaagactatatgaaaagcaagtaagaaagcaagattgctggaaataaaaaccgtgtggtgagaaattgagttcctggggttaaagataatagaggcagagttgttctagaaccgataaggctcacattgatgaagtgggaatgtagatgaggaggagtatatcctgatggacaataaaattgccacacagatagcagctttggaatggaaaaaaaataggaaagggccaggtgaccaggaaaagccctttgtgtatgaggcatggttagttaacaagaagggattgcaacaagttgtataaaaggccatttacttcagaagtcttttacatgtgaagatagaaaagtacattactataggaaaatgagaaatgagctagaaaaatgctgagtttctttggcctttattagatgtggaaaaatttaaaaaaagaaaaaagctgccttcattcaaggggctcggggaagaaaattcctgggagatatcaactgaggtagaggttgtgagaattctgctgcagatgccaggggtgtgttctctgtggagtaaagattccagcataaatgttgagaattattgatggatatcctagacagaaagtgggtggaagaaactgagtaatatggtaacagacattcataactaagagatgactagaatcagaagcccagcatagcaagaggaacaaggacatggggtggactgatgaagtgatgaagtaatgaagtatgtgcttaggaaacctgaggaccaatttgttattgattgataaatgatgttagcagactgtacaatgccctgagatctagtgtattgccagttacaaggttcttattgtctggcagcttataattcacaggtgaggtggccatgtagctgaggctctccagtgttatgaagaaagtggttaagtgaagttaaagactgtggaaacataagatggagagtttagtatagctggaaggcctggggacttcttggaaaagtctaggttttccctgagtctgataggaaaagtagcatgttaataaatgggctgagctaaagaaatagtctgtgtgggatggcatgatgtttgggcttgtggaacaattggtaaaacaagtcttgacatgaagatgagtaatggagaaaatgggaggggaagaaaagtgggaattagatgtgttgtattaatagccgtggtgaccagagcatgcacatactaatatgtgagaaggaaaaggaggagggtggggtgtcctgaaacagagttgtgcttctttgctgtggtacctcaatctgaggaagcccccttccctgcccgttcacccccagcagcacttgatgtggacagcagcttttggcaatcctgccaatgtgtgtttctgatgtcatcacagggagagtgttgtgccacatccacaccctgtaccctccactttcatcttgtctgaaaagagaacttaaaggctggccagctggttcttgcttgaaaacccagattttaaaatctgagattacaaacttgatttctcttacttattttttcactttgcttctaacagttatttggttccttgatgccacattgctctatcaatatttttataaataatgtaactaagtagaaacataatttggagttgtattgcttttaaaagttatccttattctcacagaaggttgtgaagtagtcctatatgtattttaaacttacccaaatggaatttagggttgctgtattagagttttgtttagttgtacaaaacagaaaatcctattgcagtgatttttggaaattgatgttcatttattctatgtgacatgaattctagggttatgggatggctgcagctgcccagcagttttgtgaggtcctaaagacccacctggtggactttttgtaacccccccatccccgtttacagaatgactgcaagagaaagggaagacaataaggcctgtcttgcatatatgccatactccgttttagtaaaaagaggtctccaattgctattagcagacttcgaatctgatttcagtgactagaattgtctcttctggtctttgtagccacaagggaactaaagtgactcttgtcttctcaggcccagcacaggatgctatgggagaggaaaggaactcttccatggagtggtgaaaatgaacatggattacaccatggtcttaagttttatttcaactgctaaggcaaacagtgttaatcaaaagctagatgcaatgattttgtattttgttcatttatttgctacttgttattgttaataaacaggcttaagatggacttgtttattttaaagctaaaataataaatattgtcacaggtcctaagataggaagcatttcaagaaaaaataatgaaacaaatttagactttttatgtaaagggttagggttttaatatatttgagaatgagaccttaaaaaatacatgtttgtacatggtggtttatacctgtaatcccagcacttggaaggctgaaggcaggaggattacaagttgggtgttcagcctgagctaatttaaaagtaagtgtgtgtgtttgtgtgtgtgtgtgtgtgtgtgtgtgtgtgtgtgtatgtgtatgctcatgtgtacgtatatactaacatacatatctgtatacatattttaaatctgcattttaagctttaatatagtgtcttttcattgttaacttatttgaatatttttaatttaatattttatatgatttagattttttagaaataaattaagaatgcattttttatccttgagggacttaaaatgtgtggggactgagttacattatttgacatcagtaaacaataaaaagtgtaatgtgatcaagtatcaaaagttgaattcaagaagaatggtaactgttgactgtgattacttccataacagtccatgacaggctatgtgagagtatggagtcaaatgtgttaggaggccccaaggagcaaaggcgggtctgtctgcaccacccagcctcgttgaactacatgcagattcttggatgttctctgtgttttcatgttgccatacctttagcattttttttatccatgaaaatttattgcgtaacttcttttaaatgattagttttttaaattttatattactgtttcattcatgtaagatagtattatatgatacattgtatggtacaggtccctcagaaattctaaggctctcctatacttctttgaggaagtaaagactcctcagacagcatgtgaatacatttttaaaagaatattaatggaacagaattttaatagcactgcactaaccagcttcaaaacctgggcggactctgaattgaatgctggcctttatcaggagattatcattgatgctttgtggctgttcagcatgcgcacaaaccagcacctgacacaaccattggtattcactgtgttagtgtgtttactgaaccatgaggtttatgtcaatggcagcagaacttttctgtaaaaactatgtgcaccccccaatcaagcaatattttgtccaaaacttactcactaatgtagaatattaaccaatccattagtgagccactaaaagaaaaaaaatcacaaaaagtaatcattaagttttaattattttgttaacataaagggtttggaatgccagttaaacatcatgactctgtgtactatggtcagacagtgtttacagcacttttttattggcctggcagtttactctttcaggactcagctcaaatgcaaatgttcctaggccatggtcggtggcgggtgcagtttgcagcaggaagactaggttccccaccagcctggtaagggcaattgagaacttgcacctaaaatatagtatttttagaaagggctagaatatagctcagtggaaccacagcctggcatgcacaagatctgattcatgtgccatcatgtgccgttgcctaagttctccctgaattttcaggtgtgtgtgtgggggggggggtttaccacatggcccatttattcacttgcaaggttatgtcacaagctcatgaaccacatgcacatggggactatgccaaatttacctttgagtcactgtgcctgatgtgtagtggttttgtatattggaaagttcttgtaaacctttttacacttattgattttgggtgtatatgtgtttatttgggtgctcatgcaatgacgtgtgtggatattgaaggacaacttaggggaattgggatggagctcatatcatcaggctttggggagctcatatcatcaggctttggggagctcatatcatcaggctttggggagctcatatcatcaggctttggggagctcatatcatcaggctttggggagctcatatcatcaggctttggggagctcatatcatcaggctttggggagctcatatcatcaggctttggggagctcatatcatcaggctttggggagctcatatcatcaggctttggggagctcatatcatcaggctttgaggcaagcacctttacttgttgagccatctcaccagtccccctccgtgagtgttctttagatgaataagtaagtaactgagtggatggatgaatggataaagggaaggaattcatccaaatcatgaatattgggaaagtctattcagacttgagattcaagcatacttaactattaaagaacagggtctgaaaatttcctgtctttagaaaccattgaagaggtcacccaggacttgctgacaatgcaagttgcagtaaatattggagttacaaaccaaacatctaaaattggtcaacatagctccattttccaaaacatactgtgttttcatattttctagtgcttccacttctcattcagagaactcggtgcatacgaaatcagtttctgccatatcttcagattccatttcaacttcggcagacaacttttctcctgatttgagggtatgtatgctgcgtgaacatactgaggatggccatactgttcagtgtctgaccagcactgtcagcaaaacctttaataattaagtaggtcgtggcagagagttctcaaagaccgcagactttataaattctcccagaccaggccagcaagtttgaatgcttgcttacgattttattttatttttttattttttatttatttatttatttatttttggttttccgagacaggatttctctgtgtagcttttttttttggagtctatcctggcactcactctggagaccaggctggcctcgaactcacagagatccacctgcctctgcctcccgagtgctgggattaaaggcgtgcgccgccaacgtctggctacttaccattttaaaaaatgtacatttcattccttaagttagtactttaaaatattttgtctaatttattttgtggtacttttttcccaatagcttccatattaccaggcagtaataactaacatgcattgagaacttaccataagccagttaactgttgctctaagtaaattatctcttgtaatacttgagatgttttgttatttccatgtagtatcttagattaatatgtccagagattcagagctaatgtcatggctaatcagtttagttatgtttagccagttgtattagtcagggttctctgaagaaacagaactgatagaatttattggagtgtcattcaggctgtgatctgagtagtccaatgaagggtgtctcctgatgcaaaggccaagaccctaatagttgttcattccacaagactgagtgtctccgcagtcccaatctggtactggagtcccagagaattcgtagagagctgccagtcttcagtctatgttacatcagtgaaagaaagcctcagcaagagtaaatgaacttcccagcaagagtgagggcaagcaggcaaaaacaaaagcttccttcttccatgttcttttatgtggactgccactgtggtgtggctcagatataaggtgggtcttcccacttccaataatctaatccaaaaacaaagaaaacaaaaaaacaaaacaaaaaaccctcacaggagtgcccagctgcttgggctttagttgattacagatgcagtcaagttgacaaccaaagctaacctccacaccaccgttctatcttgttgagtccaattctgtagttactaagcaccaggtgatggatcattcttacacatctcagtacattgtaaaatatccctgtatttttgccttatttctacagaattaaccacacatcaatgatagcatatttgtggattcatctgcttttcttcaaccacttgcctgcctctgcctcccttgagtgctgggattaaaggcgtgcaccaccaacgccctgccagagtttctttttaaacagtagacattcattttcatggttctagaagatgggaagtctaggttcaatgctacagaccagtgtctgcaagcatattctatctggtgttctgtattatatgggacgatctaagagaagtttactccagattgtaattcagaatgcctctctctggcagcagggaggaacagtttctatgagctgaaccctgaatagctgtacaaaggcttaattatttttacacaaaagtcgatttttttttcttgtaggaataaatactgatctactaccagaggccccatagattgccaaggcctcctaactgacacccatgttctgggggtctggatcaggtattcacaggtagaccagtggcatagaattgaaaaccctgatatcaacccacacacctatgaacacctgaaatttgacaaagaaattaaaattatacaatgtaattgagaaagtattttcaacaaatggtgctggcataactggatgctggcatatagaagactacagatagatccatatctatcaccatgcacaaaactgaactgcaaaaggataaaagacctcaacataaatccagccaagctgaacctcttagaagaaaaagtgggaagtacccttgaatgaattggttcaggagaccaattcctgaacataacacaagttgcacagacactgagattgacaattaataaatgggacctcctgaaactgagaagcttctgtaaggcaaaggacatagtcaacaagacaaaatggcagcccacagaatgggaaaagatattcaccaaccccacatctgacagggggctgatctccaaaatttacaaacaactcaagattattttcttaaaaaactaggtaacaggatatttagaagtacctaagaaataatcatagaaaatcctgaattggaatttttcatgtaagcatcaaagtacctgtttctaaaatactgtaaatgaaacaaaattgtgaaccatctcaaagcataacagtttatggaggaagaatttgttagacggctttggctttcactacattttatagacagtttgatataacagagtctcaagctggaccaaaaataattttaggtgactactgtaaagtaatccattttttattgatcgtaattttgatttaactccttttggccgttatgaaaatgtaagaaacatgtaattatatttttggacattgcattatgtagaagaaatatttttaaactttatttgattttagtttacttttatctctttttaaaattcattccaagcctgtttcattgctatttttttaattttttatgttatacaaaactataaattaaaaaatttgaccaatatacctgattttaaccaaaacccacttttacctgttaggcttaaccttgaaaacacatataggctaaagcttgttcttgtgaatgaattaaatttgaacttagcgtaactataaacctggccctgagcacatttaaaaaagtgatcatttaaagtggtttaccattaacttgtatgtcttaaccatcttttaatagtttataacaagttagcagcttttaaaagtttcaaattttacagctttactagacatacatctctaagttaacttctgtcaaccctttataatcttaagaatttatcatcacacaaaattcattctaatctaaaatattttgggtctaagaaaatttttaggtgttgccttttactaataacagctacagctattcttgactttcctcttaggcagggttttgggtattttgttttgttttgttgttttggttagtgttcttttttgtttttgtttttgttttatgagacagggtttctctgtggctttggagcctatcctagaactagctcttgtagaccgggctggtctcgaactcatacaaatccacctgcctctgcttcctgaattctggtattaaaggcttgcaccaccacggcccggcttggttagtgtttaaagcaaggaaactaagttaaaggagcacattaagtgttttttaaaatttttgtctctctttttttatttctatctccaaactgctcatgttatgcattctttcagatctaaccaacaacataccaagaagccactgtcactagcacagcacatagacagtgaagataacccttagaactgggggaatgcctttaatcttgtgtttcatggagtcttacaaaaaataatgacaagtattttagaacctttatagatatccctaaactgtcttcatgtgtttgtttaaatgaaaaataacattctcaataaacattcaacagcaaagaacctcattactgaagctatttgtattttccactatatgcgaatacaagacaagccaggaagagtaaaatgagtaaaatcagtgtttgtgtggtaaattttagagtgactgttttctataagactatcagtaagagactatttctatcagctaccactgttgtagccacgttatctgaatagctggtaacctattctgttttaggtggtatatttttgtagaatttaatggagggttcccagagagtaacttaaggaaacaggccaaatcctcaggagtgataaacagataagagtataaccaacaatatagttcaaaattgtaaattttgttttttttttaatttaccatgaaaaattaatcattcattagataatcaggaaaagagaacgtcctcaatatagtcaattactaatacctctggaaatttaaatagcattggcttagtgatttatgcccagattgcaattgtttttatatcaaaagttgggctttttaaatgtttttcccataaggggattattgatagttattccctttattagggaaaaacaaaaaccatttcccatgaagggacatttaaatattgacttactcccaatatgaggggggagaaacatttaaacaaaaaaacagccgggcattggtggcgcacgcctttaatcccagcattcaggaggcagaggcaggcagatctctgtgagttcaaggccagcctggtccccagagcaagtgccaggataggctccaaagctacacagagaaaccctgtctcgaaaaaccataaaaaaaaaaaaaaaaaccaaatgaaacaaacaaacattaacaaaattctcagttgggggttggctgcattagctgcagcagtgaggccccacccatcatccttggaaattcaggtgttgccactgttctgcattggcatgcccttagctgaaagagctgacaggcagcaagaagccagagagcggagttctagctgctagtaatttttcaatcttttggaaaaattctattcaccaataagcgaggataaaaagcttactttatttttatgatattttaggatttattgtgaaaatacgccatttttcatatgaatgtaagattttgtaattcttaggcactcaggaaatacttgtagaaaatggcagcttcatagtgtatgtagcaatactacagtttatataatttgatttaaagtagtataataagattgcaattcaaataaatgcagatcatctggatgaaatttgaatggaaaaaaaatagccttcgattaaaacaatgtttctttcttacactcccccatctaggtcctgagggagtcaaacaaattagcagaaatggaggaaccaactctgcttccaggagaaaacattaaagacatgggtctgtaatggtattttaaaatttgtttctttctgactatgcacagttgttcattctcctgtagctcccagcctgtgtgctgtaaacctagatccagagctgttgggtgtgtcctgtctcactgttgggaatttgaattactgcatttagatactgggttgctgagctagacacattggacatgtgatttttttttttaaattaaagtacagtctgtcatttgctccttttttttataattttcttccttagataaactcgggtaagttttggatgaagtctttcatgtgcattacagaacaagcactgtgtgtagacacggtctgctgcccagtacagtcctcatcatttgcgttgtgcactgagactgagcaggaaagctgtactgtgtgctcttgttctgttattcttgctcacaaaacaaatattcaaagattttgaagagcactgttaggaggatgaagaacatattttctttgctaaagtaaacaccatctttcatatttcagtcagttatcccccattaaaggaaatgcttcacttatagtgtaaaataggcatgccaaagcaaggacctatcctcagatgggctgatagtaactgccaacttagtttcttttccttccttccttctttccttccttccttccttccttccttccttcctttctttctttctttctttcattcattctttttttgtataaattttatttaaaataatcttcttttacatatcaatcccatttccctctccttaccatgatccccaccaacccccccccatcctatctcctatccactccccagggtgggtaaggccttccatgagggatcatcaaagtctgtcaagtcatttgtgggagggcctagggcctcccccatgtatctaagctgagagagtatccctccatggggaatgtgctccctgaagtccattcgtacactagggataaataccgtttccactttcagaagccacatagatccatcatttagcatttaataaagcattgactatgtctaaaattcgatgtcagaaacttggtcagggtatactatgctctttttaaaatatcttattccaaagaggtccagagatggcttggtggttaggagcacttgctgccctagcagaagactgggatttgattgccagaaccgtctgggtgctccttgagcctcggtcaacacctgcacacacacacacacacacacacacacacacacacacacacacacacacacgcaagtaaaacactggtaacacatacagaaaaaacattcattcaaagaaatgttattctgtctgcagtcttttaatgtctcagacatatagtcagctcaatactttctgatattgtatatattatggtcattttatttttaaagaaatagtgcaaaacagcaggtgaaagaggcctataaactgggaaatgagtgctggctctgtgttcatatgttgatcatctccctgccactccaacctctgacctgcttcactcagtagggacagcaggcaatctttgctccctcttcctatttctggagaggctccctttgcctttctgtttattttacaattcttagtgtaagacaaaattggaagcatggattaggctgctgaaggttttttatttaaatcattctgtggtttattttgtcacaattagataagcagtcaaattaatcttataaaatgtgtaagctgtttttaatagctattttgtcttttcagccaaagatgtgacttacatatgccccttcactggtgctgtacgaggaacactaactgtcacaaactacagattatatttcaagagcatggaacgggtgaggcttatgagtttggcttttgcctgtacatttgcttggtgtttggatgggtttgctcacttctgatttagtttttattattgagacaaagtcttatctgtgtaaccatggctgtactggaacatggtatgtagatctcaaagatctgcctgcctcagcctacaagtgctggggctaaaagtatgccctaccatacccaattaattctgggtaatttttgattcaagaatttctggttaagattttaccagtttggggggatgagtgttggagattgattgaacccagcgtcctgtcctgttggtgttattaaagcacttaacagttttttagaagttgtgtgttttcttttcatcttgcaggaccccccatttgttctagatgcttctcttggagtgataagtagagtagaaaaaattggtggtgcatctagccgtggtgaaaactcttatggcctggagaccgtgtgcaaggtaaattttacaacactgtgtggttgtatttactttggaaagctattaagtagaacctatacttggaaactggtacaagtcagtggactgcatactagaaatgtattctcatagaagcaaatgttttttgctattcacacattggtttgggctgagccagctgttaagacttcctgaagtggaagaacttcaggcagtttggtcctgtctgtctagcagaagagacataacaaagtgagctcctggaagcagtaataaatcagaaaatgatctctatatgcaagtgaaatgtagtaacagctgatcgtgttttttatttttaaaactcaagttctggtaattaaactaaggttcttgtgcttgtgaggcaagcattttgcctactgaaccatctctcctgcctaggaaaggacaaatgttgatagtgtgtattcgtcagttatttacatccccttgggccctactaagcctagacacacaggtctagattctgtgccatgtagtggagtactttgtgtttcttctgctcacagagaatcattgctactttgtgtcctggaacaattgttttgtatcctatatgtagagctttacctttactcaacatttccaagtaatttcatttcttcactaaaaaggaacaaagtgatttaactggatactgtatcttttctaggatatcaggaatttacgatttgctcataaaccagaggggcgaacaagaagatccatatttgagaatctaatgaaatatgcatttcctgtgtctaatggcttggtaaagtttctctctaacctgtaatgtaattattagtgtgatcaaactcaactaggttgtccagatcctcccctttgtgttcctgctttggcacttagccagaggctagcttgtgcccaaagtcaatttcagtaatgacattctataattatgttgactttggaggagggggaaaaattggagattgaactcagggcttcacacatgctagggaagtgctataccacagagtggttttgtttatttatgtgtctttatttgagacagggtcttttgaagttgtgtgggctggctactcctgcctcaggttcaggaggtctggactacagcctgtctctcatcttggctgtcttagttggtgtnnnnnnnnnnnccccccccccccccccccccccctttttttgaggagacaggatttctctgtgtaacagccccggctttcctggcactcactttgtagaccaggctggcctcgaactcaaagagatctggctacctctgtgccttccaagtgcacctacaattaagtagagtagaaaattccacctacaattaaaggtgtaaaggtgtgcgccaccaccgtcctactgaccacagcaactctttataaaggaaaacattgcattgtggtggcttaagttcagagatttagtccattatcattgtggtaggaagcaaggcagcatgcatataaacaatgtgctagagaagcagctgagtgctcttatatcttgactaccaggcaacaggaagtggtctgtgtcacagggtgtgacttgagcatatatgagacctcaaagccggcctccacatatcctgtaacaagaccacgcctactccaatgaagctacacctcctaatagtgctactcccattagaagccattttctttcaaactaccatatcagcttatataatatttttctttaggatgtttccatgattaaaagctttatgtagtcttcattagggtttgcaatcttcctggataggaactggcattaagactggaaatatgggtcagttattagttcagcagtattgtgacagtgataggttccctcatctgtatgatagaatttcacctaatgtcagccaacttcattcccatatgaaaatcaggatggataaggcagataatctattaacttaatactgggtttctcacttcagttgcaatttttttcttaaatactacagacttttctagtcgaatttaaaaaaaaagcttttatacactaaagtataaaaaggtcccttagtgtattagaacatacaatattacagagccactcagctgctgctgctctgtgttggaccagttatttctgttggaaagtgcatttttggagatgtcatttattacttagaattaaacctacaaaaactgccaaaatattttaaagtaataggttagcatttggaaaattttatgagtgggtctttgagcttttctgtacttcttaaaatatataaaatacttagtattgtaaattaaacagtaatttcagtcataaaactaaaaccattttaaaggaggaatttaaaatactcttgcagataagctaattaaaacataagtaattataaccctttaaggacatatttctgattgattgctttcttaaatgtctttttttaacttgtttattttgtagcctctgtttgcttttgagtataaagaagtattccctgaaaatgggtggaaattgtatgacccccttctagagtatcgaaggcaggtatgtgcttttctgttctagctttcatgctctgtattattttcattacagacagatcagagtcaggagttctttcagtgtctcttcctttttggtttaagtgaaggctaaccctggttcgcttggcttttcctttgaattgctttccagaatacactagtgatctacaaatctttgcttatctaggagtttgtctgaaaaatgtttgctctgtaaagatgtaaacagaatgagtatgtgtaaaatttaatgttcttatatgccttaatattattcactcagttttttcttattaggcatcctataatttaattatgaaaaaaataactattgattctaatttagctctgcaaaattttgggttttactcttcacagaggatagagtaacactttcccttgtgctaagggcagcattgacttaatttggtcagtacccatttattttaacgtacgcgcgcgcgcgtgcgcgagagcacgtgtgtgtggtgtgttgtgtgtgtgtgtgtgggtgtgtggggtggtgtgtgggtgtgtgtgtgtgtgtgtgtgtgtgtgtgtgtgtgtgtgtgtgtgtgtgtgtttggtcagaacccatagattttactgtcagcgtgcatgaatgtgtgtatgcacacatgtatgttgtgcctgtttgtatttgcttgcatgttttccatgcactagggattgaattcatggcctcatacatgtgagacaaatactctactactgagctatatctccatttttcatgtagatcaaagtttaattcctattaatagcttctcaaatattttccactcaactttgattcatttaagcttgaagagtatttattaatgccatgtgtgtcctttctgcttttctctactggagtcaggtgtttggtatttgttattgcttatgctccagtagagagggtactggccagttttctcactgctgtgttatcaggatgtagcagtgcctgacatgtcatagacaagtgtttgttgaatgattgaatgcatgaggctaagggaagagtttgcttacagtgtgtgctatctatgttaactaacaaatttttgcatactggtttatttaccctgtggtacttaagcacatgatgtaaaggtactaaatattatctgcatagcaagagtaaactgaggcatagggtcattaagtaatctgtccatggtaacatagctattaatgtggaagttgggaattgaatttgcaaaattatatttcagtaggtaagttagtattagtcagataccaacctgtagagctaatagatgagttaatctggaagatgactgtaaagaagttcatacatagacatggagtactacagtagagcatcagacccacaaagtcttaaaagtggctagaagaaataattctgttgggctggtgagatggcattaagcacacaagcctggagacttgagtttaatcccccaaatgcaaatcaagcacacagctgttctctggccttgacaggtgggctgcagtacccgcctttacccttctttatgtccattccctaccaataataataaattatttctttttattactgtcttttaaagaaaaaatttggctagcagtgtctgaggctatggaaatacacagcatatggcaattgataattcaggtgtcaacccaccagattctgatggagaaaatcttgtttatcaaggcttacagggggaccactgactctgaaaatgggttgtctatatctgtaatttttctcatgtgcacttaatttctttcctaagaatagctttggatgttttcccactgctcgtgtgtttgtcttgtaagaatattctatctattgtgggtggtcaggaggatgacttttcatttagctatataattttgatatatagaaaatatactaggacatgcttcctaactagatatatttgtctaacaaggactatagacacttaaaagcctgctttgttcatttttctctgactaactacacacagttagcttactttcatctcagagcaagttcaaaacaactaggctaaaagctttttgtcaatagatcataagtttaaaactttatagctatgcacaaggtcagagtcgaagatgtctgacccggttgctgcgcagagcaccttaggaagggcatgaaggttctttgcttgccaatctgttaacaatggacctgtgtctcagggtttgtcactgagcactgtgctccccaccccccactcccaatctggtcatggtcttggtcctgtgaccttgggaccttgtgtttccatgcaatggctcagctccttattgcttactctaggaatgtgtttttgaccaatgaaaggtaactcttggaagtttttttttaatcgtttcaaggctcctgtaaggagaagagtttttagaatagaagaggaagctggaggaagaagctaggaggaattgcaaatagacaggagaattagaaacagaagaatagagagactgattcagaaaagcacataatgaaagaattctttcaccctcagatatcctaagtcctccaattgctgttacatccatcctgaaccctgagaagagggtcttggggctgggcaccaaaggctctcattatggcaaattgtttttcaaaagtgaaagtggaggctagaggatagtgtgacctgattgtacaatgaaatttgctggcttaattctttatcagtaattatatcttgtagaaatggaagggaaataaaatcatctcctgacagagtactaatgaccagagaaggttctagagaatgtatactatgtatataccacagcaaatcagttaccttattactacctgatggctcttttgagaataggacactgctgtctttctgttccctttccctcccccatctaggttcacaccctctgatagaatttaatgaactaataggctactaaacattacatctgatgcccccccctgaaaaaatgcagatcctcccattaaaatatgtgtcttcctaaaagtctggccacatcaccatttgagcagttttaagatatgagaactggagataggtgagtggcttactgtcctggtgtctattttagctgacagtttgtctcttgttttatgtcatgtgtagggaattccaaacgaaagctggagaataacaaagataaatgaacgctatgaactttgtgacacatatcctgccctcttggttgtgccagcaaacattcctgatgaggagctaaaaagagtagcatctttcaggtcacggggccggatcccggtaagtaggctgagtgccttgagactctgtaggtacatttcagtacaggatgataatggccatagcatttatatgaggatatcagagactaaattaaactgtaaagttgaaacagagttgcctagttcctaactcaacatttgccctgtgtgttggttattctttatcttatatattctttagtcatggcaataaatgcttttttcttactgagtcaaagagtagaagactacaaattgatgatgtatgtatgactgtgtctcaaaagagcagatgaaataattttagaggcagaagcgtagaatccgagtcctttatagttttactgatatagtaataaaaaaaaacaagtggagtttgtttagctgttttattgtactttttctaagaaaagatttttcaataataagttttacaacagtatctaatttggaagtaggcaattctctacaaaacagttgactagaaagtatggtggcatattttcctggcatccagggccctcggcctgttctgccagaagtctgctctctaggagacttacaagcaggatagcaatatcaccatgttcctgtcattaaggttttatcatggattcatcctgaaagtcaagccacagtcactcgctgcagtcagcccatggtgggagtgagtgggaaacgcagcaaagaggatgagaagtaccttcaggccatcatggactccaatgcccagtctcacaaaatatttatatttgatgctcggccaagtgtcaatgctgttgccaataaggtgagggttgttttgttttttatttttagtaattatttgtcactctggtgttgctaaagccagctagatttgtctgtgctgttgcctggtaaaaagtggtcagaccctatggaggcagagagaggtcagactacactgaggaaatgatgatgatgatttccaagactgcatttcatttgtattatagaaaaattagttcatgcatttagctaagtagatgaagaaaatgttttaaaatgccccaaaacttggaacatcattaagttttgcttgtatttccaggcatatgtagttttctgtaaatatttgaagtgaaatggaataatttttgtaagttaacacattttatgtcactgaaaacttataatggtttcttaatgtctgataataatcacagtaaacattagactttttttgtcctcccattgtgagaggtgcttgagtgaccatccttaactcatggaggatatttctcattctgcatctgcatagtttgtttaaggccattgtgaactccaggtgtcctttgcaaatggcccttttaaaggaggtgagggaggaccatgatatcttaagtcattgcagtggtaaagcatagttgttggtttggttttttgttgttgttgttttttatcatttcttttttgtcagttaaactgatacccttcattggggtaaaaactacaaccaagttcattataaaagattttgtaatgcagaattgtttcattcaattagtattaaataatttgaatgctcaaaattacaggcagttttcaaaagcagactcacatcattgtgaacatcaaacaggcaccatccacagacatgttttatcataattttacattatactgtttaacacactgctcatcaccaatagtctttcttctttatgttattcttcttgatattttactgagtgtgatgcataaataaagcctgtaaccaggaagtcagatgttttctccaccaagtgctgattttcctccctaaattctgaccatgaataaaagtaaaaatcagacttagtcatctgtgagaaggaaaggcagcaactgtggtagggcaaagtgttgatgtcgtcaactctccctcctctacacctcattctggaaatctgcagcaagtataggaggagcagttttcacaccttgatgaattactgttgtaactgctcctgtggccaggatcccactgagccacctgtaccctaagggcagtcactttcttgctctgcactcctcacacatctttatgtatttcacaggtgtttacctctgcactctgcatgtcagctcatcttccagaatattttgttcagtgtcttaggattttgatctgtggtctccttttgcctatccagcttttcctttcatgtcacctgactctgtcacagtgtgggctgtttttattttgttcccaaatctctgaggtgaacgtgaggtttattcagatttaggttccatttgttctgtgggccactgctgactgttgaatctgttactttgattcacttgagctaaaatagtactttttaaaggtactgattgaattctttttgtaaagtgatgcttctcttacctttgattaatcaggataaatgcttcttaattctcagacatgagaggggctgcacaggtaggaatttatagagattagatagtgttggttgttttacacctactttaggccttagcacttggctatcaggatggaagggcccctcttagcttagggtgcatagcctctcactgtggagacaaggctagactgaaacgtgaagagatctgcctgcctctgcctggtgagttctgggtggggctaaaggttgagcctctgtggtaaggttactatacttctaagattaaagaagaaatgtgactttgtggacattcttctgactaaggtcatctgtgaccattgcagtctggtgccttccattcactgatggcagtcaacctttgggactattggtagtctgccctgtgcttgcctatacttggtagtttgagactcagtagagtagttaattaccaagtttagttttaaatgcttttcatcttttgctttactatctagttgctgtttaaaaaaaaaatacttaacggagatataactcagtgtactataagaaagtatccgttcctttagtgtattcacagcccatcgtagctatgagttctgtattatttccatcctcgttctgtagtgggtttctagagtaggtactgccatgctgtgggttgtagtatttcttcctgtttctgtgatgggctattgtagtagctactattaccatctcctgaaattcgttgcaacgaaattgctttgaaaatttctctatcctcaatcttacagttactttgttagttactttttatatcctggggcagaacagctgacaggactgctgtgagcatgtgccagttactcgctgaggcatgctgggagaaacctacgtcttctagctaggcctcacattgtaaacatctcccaacaatctccctaatagtactagcaactagggaccaagtatacaatataagcccatgggtgacatatgttcaaactataacacccattttcactcttcagaagtcatctttgttaacaagtattaccaacatttacttttgtaataatgttgaatacaaattactccatggactagaaatccgacaattttttaaattagtttggagttgaattcagaggtatcatagtcacgatcctattagtggagttgctctactgtactcccaatttgctttttgataaggcttcaagaagtgtgattttatgtatgagttaggcaagacagaagatttttttatgtactatatgtgaaacattctgatactgtcaacagatatgaagacatcaaaaatatagcttcccccatgggagtaggagctatgtaggttttgtataggcctatccctcaactaatcttcaccacatggcagagattatcttcatcctttttccagagcagtacctgtcatctcaagagcttctgaggatgtcctggcattttctaaatgtaaatccatcttcattgctttacggtttgacagaagatttttttaaacataaaatctaatattaaacttgggaaaattatgttctatttttcagctatagcttgtttggaaaagcatgcattttcttattttatagatttgaggatagtaaatgtcagtgggattctctgtttgtatgttaaatttaaaatgaatcagctgcttataatataagcaaactgaaagttaatcttgtcagtttgattgaaaagaggactattgtttctgtgagggcattttgagagataaaagctctgacctgcccaatgggttaatccatttttttatttacattttagattttgcaaagtttagtatatagcaggtagagcttagctgggagaaggggactacttggggtatacctttgagcggtggccttctgcccttcttgctactcttccctgtagcctggctgatatgtgtgaatgattttcctttgccatgttctttctccatgatgaacacactccagaaatgtggggcctacctgtggactgaaacctgtggaactgactgtgaagtaaatctccccaggaaatccttcctcaagtattggttcacagcaacagaactctaacttggagatcattatggctacaatgaatttgtttttctattattaactgaaatgatatgaaaaggaaaataagcttgggtggtctagaatgggactcttgcatgcagaaatgataatttgattatttcagtatgtttgaagggaagtctacataagaagttatagataggatttgatacacacaggaaaagttttctttacaatgctgaagtgctttgaaatgattcagaataaacaaactgatcacataggcttagcacagactccattttagaaatggtatgagtgtgtgtttattacaagtgaccctgagctactcctgctatccttatcctcagcaatgtccatcctattttagatagtttatggaactttgtaatggatgtcttcaaaagatggctactcattcatttatgattttctgtgatttgtgccctttagcaggcaaaagggggaggttatgaaagtgaagatgcctatcaaaatgcagaacttgtttttttggatattcacaatattcatgttatgagagaatcattacgaaagcttaaggagattgtgtaccccaacattgaggaaactcactggttgtctaatttggaatctacacactggctggaacacattaaggtgtgtatttgctactccttctcaaagcctccactcctttgcttgccttggctcttgtaactgaaatcagcaggaaggacctgctgagtagtggagccagtggctctgtgcacactcgggtctgaaggagctgcatcctatgctgtgcatgggtttctgctgcctcttgttttcctcttccatctgaattctgtccatactcaagagacagtgtctttcacttctgacagtcttcgcacattgtatccatttccagtctcttaggttctcaacccctactcaacttatatgccattcttcatttatttgactgtttttgaaacaagttctcactctgaagtccaagcagccctccacctgtgactcctgggattataggcatgacccttggcatctgcatcctttttattgttgattgatgcttcttgccatgtgactgaggtagtttttttttttttggggggggggttcgagacagagtttctcgtgtagctttggagcctatcctggctctggctctgtagaccaggctggcctctgcctcctgagtgctgggattaaaggcatgtgccacctacacctggctgaggcagttctatgtaacagaactatattagtttcttttaagacgtgtttaacattttttattagactttcattttacaccttgtttccagctcattcttgcaggggctcttaggattgctgacaaggtagaatcagggaagacatctgtagtggtacactgcagtgatggctgggatcgcacagctcagctcacttccctggccatgctcatgctagacggatactatcgaacaattcgaggatttgaagtcctcgtggagaaagagtggctaagctttggacatcgattccaactagtaagtaaagaaccttcattttatcatgtgctcatgtgggcatgtacatttgtgtgcaggctaggggttgttggttttcttcctcagttactatctaccttactatttagagacacacggtccttcactgaacccagagttcacagctagccagcaaaactaagagatctgccatttctgcctgtccatgctaggactataggtatgcatattatgcctaacttttacttaggtgttgggaccaaactcagatcttggtgtttttgtggtaaatactcagattttggtgtttttgtagtaaatacttaatgatctatccagcacattcatttttaatgtttcacaaacatcttgtacgagagagaaaaaattggccatttatttagcagagtgaagtcatgagagcactgtatttggtaaagtgttagtatattcttaatgtattgccatctgaacccaggttggtttaggcatatgaccttgtctcttctgtggtttctacctagaaattcagctgttactaatggccatggtgctgtccctccaaatggagcataaagtattgctagctttccctttggccttgaatgaaaaggacagtggttcagttactaattcagttacatataatgttgctaatgtagttcagggtctaaaaaattattaactaaaataatagagtaaaaaaatctggggtttcaatggtcaagaacatttgctcttgtggagggtttgagctcgtttcccagggctcagattaggcagcttccaagcgcttgtaacgagagctagaggatttggcactagccttttggtgtcagtcttcatgtgcacatactcatgtacatagaaataaaaattgaacatctttagactaaaatctacctccctagttattctttccataaatttggaaagttttacagattctcttaaggaaattgcaaaattttgagccctgtgttgttccaagttttttatttagaacttctggttaaacacagggatgtatacaacctagagaagcactctaccactttaaaagaaagagaagttttattttgagacatgggatcttgccaagtttccaaggctgacccctaaatgcagcttacagttccacttgtgatcttctagcctcagtgtctgagcaactagagttttctgtctgtcccactgggactggttttttgttgttttttgttttgtgtatttctaaattaggtggtgctgaaaacgtgttgttagttggattaaaatgtttatccatgaattcaaagtatatacctaaaacatctaagttgtacctacaaaattagtgtttagattcatgtccagaaataagcatacaccccttcttgaggccagcagtcccacttaagactcctgctggaatttccttgtgataatgaaatgaagtttcctgcttcctattgttccaaccctccctctggagacaaatgaaaagtgttccttttatttttcagatatttgaccatagctgtctccccacatcacccataagcttcagcttttccgaatgaacatccttgatgggctttgtctccccatcccagttgtccaccagtattactaatggctctctacaagtgtggtacccatagcttctctcagttctttagtgaaatggaattatgtcctccttgaaaagagaaaacataattgcctttgcttccttgtactatgctttggactcagggcattcttcagtgggatgttaaatctgctcaaggctgtattggaatcaggaaacatgggaacactttaccttgtggatctctgtcttcctcatgttatccatctgtgttattgtattggaatcagagtgaacactggggtcctgttcccaggaaggagaagtaggataagcagatgtctgggttaagaatgagtaataaccaaggcaggaatctggagtctagaggagggagaagccagagcattagaggcctggaaggcactgaggagatgggtcctggcatctgcataggtgctctttaatattattagtctttccttcgaaacactgtttactagcagtgtttataggtaattttaaagaactagaacttgaaattggttgcctctttttgaatgtcaactgtcaagcaaaactaggcagctgaggcatctccctcagtgcctcacactttcccattttttaagaaattaaaaaaatttcttccttaaaagtgtcatgtgttgctggggcagtggtggcgcgcgcctttaatcccagcactcagaggcagaggcaggtggatctctgagtttgaggccagcctggtctacagagtgagttccaggatgccaggactatttcacagagaaaccctgtttcaacccccccccccaaaaaaaatgtcatgtgtttcaaaaccataaactccttgattgcttgctctggtcacccattttccattctttctagttgcactattaatgggctcctttttcttttttaaaataaaaaccagtcaagaaggcatgctactgacaatctgttgaagtttatgaggaaaaccttatgtaggtagtctcataggagcccatttagagaattatggttgttttgaaatctgttaaaatgtagcaaataataagtttgttgtagaatccagaaaaagacaaaacaaaacatatctttgtcttgtctcccctgaattcttttagtctcctacattttctatagttttttgtaacagtatatattggttatgtgaaacacactaactcatgattatacagagcctcctgatttattgtttcattctactgattcagaggcatatgtatgtggttttatcagataagtggataaggcaaaagtttactgaaactctgatcttcaaattattagcaccaaatactatccatagtcttttacattaaggaaaacaaactgtatatttttgaaaaaaatccatcacatattcaagtcttatgagagccatagttaacattaaaatgttatatccttccattctgatgcataggataatcgaaaattgtataccttttccattttgtcatgagattaaaatgtttactcatagataagacttgttaatttttcttgctttgccaataataccctctaagaaaacttgattttctaccttcagttgtgagcatctggcaggatagaatacatacagtctactgtggcccatcaccacagcctagcttgacaaccaacagcagtatgcatttgcacgagtaccagtgctactcactgggaaaggtgaaccaaaacaacatcttagcagtatgactgtattttttttttttttttacatggaaacctgccccagaacttttatgccccactttttaaatgaatccctgctttgggatttttcagttgcatggttgggaacccatttgtgtgaaaaacagatccaagtacttctgaaagatcttgagatttgtgctaatgtagctatcttcttaggaggtgctttttgtcccagtgacctttcataacgaatatcttgtcataggaagttaaatctctagaacaaaactctgggctctaaggctcctctgttgttttagaatctgggtttcatttaagtagcaatgtgacagttttgaggaaattaaaaatactgaccaaattatacttttagaaaataagattctactaagtaaaatatcttacatgtgacatttcattctttgcttcagagagttggccatggagataagaaccatgcagatgcagacagatcacctgttttccttcaatttattgactgtgtctggcagatgacaagacaggtaacgcatcatctattaatacccttctcacacatctctaagctcaaagtggggaaacttgatcactgtttggcttgtgattcttgggtagaattcccagtgataacagctgttactgttgggcattaaaactttttagaagttttaatatgaataaagagcttgatactagtagcatcgcaaccaggggaactgataaaaatgaagattcctcctgtataataatagtcctttgctcactgaaagctctgtatactttgctaaggaagatgaagaaacgagctacattgattccagtcggaaccagacactattttgagtccttttagctgttttaaagaaagaagtatttggacagagtatcaaggcagcgatcacttggccccttctcaatgtggagctgttagaaccctgtaacagcctttgaagtagttgggtaaactgaccagtcttgaaaggtactagaagataacacttggttttacaataggaaacggggctgcagggtcttgaaaatggtttcaggagtagggttaagcctgaaggcatagttcttgttactggagacataccagtaagataaataaggcaagaatttgacccagctgtctgattggtaggatccaccaaggtcactaggtataacctgggagctgtgactgactagagtgctgtttgggtaggatggggagacattttttagaaatttaattctaaactaagaagggggaaaaaaaaaaccagaagttgaaagttaatttaatcagcattttaattacttagcaaaacaagcattagcagtaaactacatgtctccatagattttagttgacaggaactttttctaaaataccaagacagtattttccaggttgttgtggaatttttcacaaactattcagatttacaagtatgtttctgaatgattttgaaataataacagggtggattaaattaagccttttactaccttttggtggtctgtaatttaattcttcctttggtcctccaaaattggattgtataaaattaagatacccactgaagcttgtataggggtgaattctgtgttggactgatgttgccaattgtgaattacaaggacctgttcttcaacaagataaataggttgacttgtaagttgactgcatagctgcacagttacttacttctgtgtatatagtgatggcatttgccaaacacatttgttatttttaattcttagaaataagatgtgatgaaaactaataaacatggaagaccagactcatcagaattgctccaagtcataagtcagtggctggcaactatagggtcaaggcagagcagacacaaaaccagcattaagtccactcaatacttgctgcatgagagaaactctaccttgcaaaggaaaacatgccacaaatgcttaggtagtttcaaatctgtctaagtattattacagaggatctactcacgacagggataattatccctgaaaaatgtcttaaatttgtgtgctcaattttgcagttccctactgcgtttgaattcaatgaatatttcctcattaccatcctggaccacttgtacagctgtttatttgggacattcctctgtaacagcgaacagcagagggggaaggaggtaaggtatagctctggctcttactctggtatttggttttttgtatctcacaagatatactagtatatacttccatccgtgaagtgtgggggtgagaaaatcacacctataatcccagatactccagagggtaaggtagaaggatcacaaatctgaggccagcctttttaaacagatcccatctcaaaagacgtctgaagaaaagaggatgctggagatgtagagttcagtgatggactgcttgcctagtgctgtgaagtgctgggttcaatcctgctacaacaaaaacaaacaaaagaaccactctgtagaagcatcactgttggtggtactggtagttccctccatgcacatcaatgttcatcctaaaaactgtcagaaaataagggtactcacactgaaaagccttgctaccaggttcagatgttactcactaatatgcatgttcattcttatttctgtaaagcaggcaagtagatgaaaattaagtgcttcttagactgtactttgcaggtattgtatcttacagtgaatgtatttctgtgcatggtaggctttccatatgttacgtggtactagataatcaccaatagagcactgcagtgttctaattactatcacttttgagaaacccccttgatttaagtcttagctgtaatttaaataccataagccctcttttaaagtggtaatttaatggtatagccacagaattggaaccatcaaaatttagagcattttcatcacaccagtcacccatacctgtctatccacattctctcaggtttgggtagatactaacctggtttctcaggaattatgcactgtcattcaccatgtgaaatttgtgtctagctccttgcattatcttttcaacatttatgtcatagtactttcttttcttcatggtcaaataatcttccattgtctcaaatcaatcttcctttgggttctttattttggttgttgtgaatagtattgctttaaacatatggagcacttttattttttgtgtatgggcatgtgtgtttgtgcatgggagaccagagaggatattagatgccctgcagctaatgttttgagctacccaatgtggataaattttgatcctatctccagcactgaggcactttatgtaccagtgtttttcaatctgcaaatacaactgttgggcatttcatgttaactgtgttcatttccatcaaagtaggtctattagcagttagtttcctctattgttgactttaataatcacacagtacacaagtactgctgatgtggtggggaatctttaccagttttttcctcttgcagaatcttcctaagaggacagtgtcattatggtcctacataaacagccagctggaagatttcaccaatcctctctatggaagctactccaatcatgtcctttacccagtagccagcatgcgccaccttgaactctgggtaggatattacataaggtggaacccccgaatgaaaccacaggtacagatctacaatatacagtataactctactaggtctgtcacactctctctgtccattagtaattacaatccacagagtcacagaagcactgcataagacaggagactttcccaagtgcacacatcctgaagaaaataactttataaaagcctaaaaacagcaggtccacagttctgaagagttttagctagatgatgtatttgtaaagtagcatcttccagaaacgtaaagacattgaaagatcagtgatgacaataaaaccttgctttaattccactgaggaactcggtgtcacaaagccagacgaatggttaagatcttgtttggctgggattcctattacagtaattttgtttgctcttgcaggaacccatccacaacagatacaaagaacttcttgccaaaagagcagagcttcagagaaaagtagaagaacttcaaagagaaatttccaaccgctcaacctcctcctcagagagagccagctctcctgcacagtgtgtgactcctgttcaaactgttgtatgaaaggactattaggtcaagggcctcactgccaggaacttgacattacagcaccttacgggtagaaagccttccatgtttttaaacccatctatgggagaaaccttcagatgctgtatttatttcaagtctctcttagatgagtttggaaatgtctggtgcaggtgacaatggaaatcatttcatttgtaattaaagtatgacactaacttaagtcacccaaagaatactaaagtactggagtcctatttccacagtggggacacgtttttaattttaaaatgtcttaaaaaccaagcacctggtaagatctctaggtgggagaaaagaaagagcagctgttctaatacccaagagcatatgtctgggccttcatgtaaatgtcagatcaaattactcccttctcagatttctcaatttttgtggtatttaacagtaaaaaccattgttttgagattattactgcatatcaatagttaaaaattgctgctgacattgtaactagggtattttcaacagcagttaggaaatgatgccttatatatgtgctttggggggatgaggggacaaagcagtatctgtcatccaggaattcaaagaacattccacacccttcagactaatttacatttgtgtgttaatcgctaacatcacagaagacattttagaaactattactctattttatcttagtgataattggcaagttttaaagtctgactttagtgctatgtttaaatttcacatgaacagtttaccaaagaacacactgcatgtaaggaattacaatctaagtgccagcaagtaaagccttgtttctctattcacctgagttgggtgctggtgtgaacaactgacctcctggtatccattttactctgtataagagccatatgtaatgtactgtaacaaaggagcttattaccacttggtcttttaattaaatgacttcaaactttg

SEQ ID NO: 7 - DNA, 2317 bp, Cricetulus griseus
tctttggttcagtgcggtggcagcggcggcggcggcagtggctgctgtggtgaaggaggaggaggagccgagcgggcgttggtaccaaggcctgaccatggacgaggaatacgatgtgatagtactggggacaggtcttaccgaatgcatcttgtctggcatcatgtctgtgaatggaaagaaggtgctgcacatggaccggaacccttactatgggggtgagagctcttccatcacacccctggaagagctatataaacgttttcagttgctggaagggccccctgagtcaatgggccggggccgagactggaatgttgacttgatccccaaatttctcatggccaatggtcagctggtaaagatgctgctgtatacagaagtgactcgttatctggacttcaaggtggttgagggcagctttgtatacaagggaggcaagatctacaaagtaccatccactgagactgaggccttggcttctaatctgatgggcatgtttgaaaaacgacgcttccggaaattcttggtgtttgtggcaaactttgatgagaatgaccccaaaacctttgagggtgtcgacccccagaccaccagcatgcgtgatgtctacaggaagtttgatctgggccaagatgtcattgatttcactggccatgccttggcgctctaccgcactgatgactacctggatcagccctgtcttgagactattaaccgtatcaagttgtacagtgaggtcctggccaggtctggcaagagcccatatttgtacccactctatggcctgggcgagctgccccagggctttgcaagattgagtgccatatatgggggaacatatatgctgaacaaacctgtggatgaaatcatcatggagaatggcaaggtggtgggtgtgaaatctgagggagaggtggcccgctgtaagcagctgatctgtgaccctagctacatcccagaccgtgtacggaaggctggccaggttattcgtatcatctgtatcctcagccaccccatcaagaacaccaatgatgccaattcttgccaaattatcatccctcagaaccaggtcaacaggaagtcagacatctatgtgtgcatgatctcctatgcacacaacgtggcagcacagggcaaatacatcgccattgccagcaccaccgtggagactgcagaaccggaaaaggaggttgagcctgcattggagctgttggaacccattgaccagaagtttgtggctatcagtgatttgtatgagcctattgatgatggttctgagagtcaggtgttttgttcgtgctcctatgatgccaccacacactttgagactacttgcaatgacatcaaagatatctacaaacgcatggctgggtctgcctttgattttgagaacatgaagcgcaaacagaatgatgtctttggagaggctgatcagtgattgctgactcccctcctccagcccctgctcccctttccccaacctgtatgtcctttggggcagggaagatggtatggctgggtatccctgtttccagcatcttctgtttcccccaccacattctgatcacttaccttgttgatttgattcactgaccaaatccttaaccttagtgatggtttgggagatgggggttgggtagtatcctctttcttggttctaggaaaagaggattcctgtgtgtgagcacatgtgctcacgagtgtgtgagtgtgtgtgtgtgtgtgtgtgtgtgtgtgtgtgtgtgtgtgtgtgtgtatacacgtgtacaccctaattctgctgtttgggaaggagtggaggaaaagctgactctgcccccactgttcttactcctaatgtagtggcctttggagataccccatctccacccccaactcttatgtgttggagagaaggggccctcccagcacaaaattgcattcctcttcccccttataatttattctaatttattaactttgacctatctgtctgagccttcagcctttctgtgcagcctggggctgtagagttagctgccctggcctttcccatccctggcaaagtctgggttgggtgaaggtttatgtgtggccccctttgggagttgatctatttttaatttcttgtctttgtgttgtgttctttgagaaaacgtaaatgtgagcaaagcagaaggaggtgggaaagtggatccaaaccccagtgtgccctgcccaatgccttttcctttagtggttggaaacccttatcttgcaaagtgaatgtgtccccttccccaacctctagtgtatttcaaaataaaacccctccaataaaactgttgaaacctga

SEQ ID NO: 8 - DNA, 4001 bp, Cricetulus griseus
ccaagatgcccatcaactgattaatagatgataaaattattgtacatttcagtgtaatattattcagtttttaagaaaaatgaaattatgtaataagcatgtaaatggatatatcttgaaacaaccattccccattatattacctaaacattgaaagtccaaaatcatatgatctttttagtggatctactaatcttttgctatatgtattttattgaactacccatggatgtgagataattggtaacaacagcacatgggagagcatgggatcattcaaggaagattagagagaatgcattttttaggagataatggaggagcaatagaaaggattaaatgaggttactgatgaaagtgatggttagagaaggcaatatgaggagggataactagcacttagggccttttgaaaaagacatagagaaaatactattgtagaaacttcctataattggtgtatagttatatacaccaaagagctcagatggagttaccctataatggaaatattaactactttttatcactgtgataaaacatcctgaacagagcaacatagattgggaagcatttactttggcttacagttctaacgggataaaaattcatgatgaaagaatgaatatgtcagcaaacagcagtagcaatggcctgagaagcaggtgagagctcacatcttgaagtgtaagaatgtagcagagagaacaaactgcaaatgaccagaaaatgcttttggatcagagcccatacccctctgactgacttctccagaaattctgaacaaataaaactccccaaacagagccataactgaaggtccagtgtctgagactactaggggtatttcttattcaaaccactacaatggggtggggggagcaatcctccaagtaggcactacacacagacaaataaaaactctagtaactggaatggattgacttatttgaattacttgccagtggagctacatagagcacaattattgtatttaaattaccctttatgatcttacaaaacttgacagtaagatcatattgctaaagaaaccacatatttgaatcagggaacatggtgatatctagttgttcttcaactggaaacttcatgctttctgcccagcattcatgttgctggaaagagcaatgtacactaccagtgtagaaattaaatcatcaatcttatcaagatgtggatcctataagttacaataaaaattagcctgataagatatccccaccagaagaatattcacataaatgctatgggagcaacaagctattttctaaattagctttaatcctattctacaagagagaatccatatctagaatagttatagggatcaagaacccatggcttgattggtcataggcccaatgggagatcctaatattattgttctacaaaatgaaaataactcctaatgacttgttgctgcagtaataagttagtatgttgctcaactctcacaagagaagttttgtcttacaataaatggcaattaaagcagccccacaagatttatatcataccgatctcctcatggcctatgcatctagaagctaggaaacaaagaggaccctaagagagacatacatggtccccctggagaaggggaagggggcaagacctccaaagctaattgggagcatgggggaggggagagggagttagaagaaagagaaggggataaaaggagggagaggaggacaagagagagaaggaagatctagtcaagagaagatagaggagagcaagaaaagagataccatagtagagggagccttgtatgtttaaatagaaaactggcactagggaattgtccaaagatccacaaggtccaactaataatctaagcaatagtcgagaggctaccttaaaagcctttctctgataatgagattgatgactaccttatataccatcctagagccttcatccagtagctgatggaagcagaagcagacatctacagctaaacactgagctagttgcagacagggaggagtgatgagcaaagtcaagaccaggctggagaaacacacagaaacagcagacctgaaaaaaatgttgcacatggaccccagactgatagctgggagtccagcataggacttttctagaaaccctgaatgaggatatcagtttggaggtctggttaatctatggggacactggtagtggatcaatatttatccctagttcatgactggaatttgggtacccattccacatggaggaattctctgtcagcctagacacatgggggaggttctaggtcctgctccaaataatgtgttagactttgaagaactcccttgagaagactcaccctccctggggagcagaaaggggatgggatgagggttggtgagggacaggagaggaggggagggtgagggaactgggattgacaagtaaatgatgcttgtttctaatttaaatgaataaaggaaaagtaaaagaagaaaagaaaacaggccaaaagattataaaagacagaggtggtgggtgactataaagaaacactattatctaaataaaaacatgtcagaagcacacatgaacttatagtgtttatgaaagtatgtataataactacataatctcaagccaagaaaaaaatatcatctttcagtgatgaaggtgattttatttctcccagaattaaagccaaagacctaatgaaagtaattatcttcaaaaggttgaaaatacatactttgcaatacacagatctgcctagaaatctcatgttcacaatacacatgatgctcaattgaattccattcaatgttacagtttagataaacagtttgtagataaactcacaatgtatcatttctttttattttttgaccaaacagcttctcatctgttattcagaataattcctcgatggcaggatatccatcccaattgggggaaggggagaatttgaagaaaacctagaccacatacatatttgccattgggaaacaaagtctaaaatgatgttgttcacatcttctctactagtcctctccccgtcccaaagaaccttggtatatgtgcctcattttacagagagaggaaagcaggaactgagcatcccttacttgccatcctcaacccaaaatttgcatcattgctcagctctgcccttctcatatgacagttacaagtcaaggcttccaaagtccctctgtcatgtttggtgtcaatagtttatacagatgacttcatgtcttcatatctaatgtcttatatagattaatattaaacaatgttatttctctaaccacattttaaattaatttaaaaatccattaattgtgtctataaaatgcagacagagtgctgagacacaatataagcctgatgatctgaatttgaaactcacacccaccacatggagaatcaacttccaaaaattttcctattacttccacacttacaccattgtacaaacacaataataatgaacaaaatgaaatgaaataaaaaattaagtctctgtaggtaatgctactgtgcagcaaaagtaaaaatggcagcttaagcttgctttatggttacactttaccatcttccattaattataaggacttcaatcatggcagaactatgctgttattgtctcagtgtaacctaaccaggtgttccagatgttcttaatgtggacacctaaactatttgatatttgggttaagatctttccctctttcagaagaaacctcaggacagagggaatcttgtcttttaattttgagtctgtagactttttccatttcaaatatacatgaaacaagtgatgaagaaaattaatcaaaaggtgggaattgcaatgatattaggttcaatattaagcttcaatattatcatggaatcgcctgttatacactgagtgtttggcaataagggatttttagaagaaggagtttttattctcaacaggttccttaagtttagctcaaataaatctaagcaatccactctagaattaaatagtttcc

SEQ ID NO: 9 - DNA, 1001 bp, Artificial Sequence
  synthetic polynucleotide
taccctttatgatcttacaaaacttgacagtaagatcatattgctaaagaaaccacatatttgaatcagggaacatggtgatatctagttgttcttcaactggaaacttcatgctttctgcccagcattcatgttgctggaaagagcaatgtacactaccagtgtagaaattaaatcatcaatcttatcaagatgtggatcctataagttacaataaaaattagcctgataagatatccccaccagaagaatattcacataaatgctatgggagcaacaagctattttctaaattagctttaatcctattctacaagagagaatccatatctagaatagttatagggatcaagaacccatggcttgattggtcataggcccaatgggagatcctaatattattgttctacaaaatgaaaataactcctaatgacttgttgctgcagtaataagttagtatgttgctcaactctcacaagagaagttttgtcttacaataaatggcaattaaagcagccccacaagatttatatcataccgatctcctcatggcctatgcatctagaagctaggaaacaaagaggaccctaagagagacatacatggtccccctggagaaggggaagggggcaagacctccaaagctaattgggagcatgggggaggggagagggagttagaagaaagagaaggggataaaaggagggagaggaggacaagagagagaaggaagatctagtcaagagaagatagaggagagcaagaaaagagataccatagtagagggagccttgtatgtttaaatagaaaactggcactagggaattgtccaaagatccacaaggtccaactaataatctaagcaatagtcgagaggctaccttaaaagcctttctctgataatgagattgatgactaccttatataccatcctagagccttcatccagtagctgatggaagcagaagcagacatctacagctaaacactgagctagttgc

SEQ ID NO: 10 - DNA, 1001 bp, Artificial Sequence
  synthetic polynucleotide
caaagtcaagaccaggctggagaaacacacagaaacagcagacctgaaaaaaatgttgcacatggaccccagactgatagctgggagtccagcataggacttttctagaaaccctgaatgaggatatcagtttggaggtctggttaatctatggggacactggtagtggatcaatatttatccctagttcatgactggaatttgggtacccattccacatggaggaattctctgtcagcctagacacatgggggaggttctaggtcctgctccaaataatgtgttagactttgaagaactcccttgagaagactcaccctccctggggagcagaaaggggatgggatgagggttggtgagggacaggagaggaggggagggtgagggaactgggattgacaagtaaatgatgcttgtttctaatttaaatgaataaaggaaaagtaaaagaagaaaagaaaacaggccaaaagattataaaagacagaggtggtgggtgactataaagaaacactattatctaaataaaaatatgtcagaagcacacatgaacttatagtgtttatgaaagtatgtataataactacataatctcaagccaagaaaaaaatatcatctttcagtgatgaaggtgattttatttctcccagaattaaagccaaagacctaatgaaagtaattatcttcaaaaggttgaaaatacatactttgcaatacacagatctgcctagaaatctcatgttcacaatacacatgatgctcaattgaattccattcaatgttacagtttagataaacagtttgtagataaactcacaatgtatcatttctttttattttttgaccaaacagcttctcatctgttattcagaataattcctcgatggcaggatatccatcccaattgggggaaggggagaatttgaagaaaacctagaccacatacatatttgccattgggaaacaaagtctaaaatgatgttgttcacatcttctctact

SEQ ID NO: 11 - DNA, 14931 bp, Cricetulus griseus
  misc_feature (2176)..(2239): n is a, c, g, t or nucleotide is missing
catgtacacttatgcaagtatgatatggcccaacacagtattttacaccaatttttatctataaaatatacatgtacatcaaaatatattattaataataacatcattattctttctttccaagtaataaacacatacactgaaattttggttcttgtggataattttaatgaaacaggaaatgcaaatttatcttagcatgtttacttcactttctttgcatagataaccagtaatcacattgatggatcatgtagtgaaatgtatttttaggtatctaaggaattttggcttcgttttgtgcttgttgacactgaattctattcctaacaacagtgtgtaaggattctgtctgatttcttttaccagtatttgtccatttgcattttctttattattcatggctgctgttctagaaagtggaaggtagtgtgtcaagtctgtttaacatgtttccctgatgatcagtgtcttaacacctctctgagtacatgttggccaatgtcgtttctagacccatctattcttgcttgacttatcctggtacatgcctgccaagaaatttctcctcatcctttctgtctcttcactgatttacttgatgtgtggatttcacattgatcatatggaaatagaagatacaattttctttattcacagtttggaagactttcaatctcatagatcatcattattttttgctactgttccctatgctatggtgaaatttccatttgaataattgcttaaacaattaacaagaaagaatctatttttacttgcaataacttccatttcagaacatttactacactgttactatatccaaaaactagttttatatatcatgtgagaaatgactaattcataatttggccatgacatttttttcagaaacagaaaaagtgaccaatacatacacaatgctataaatattaagacttcagcaaattaaatatttattcatgatatcacataaaattcatttattatgttttatttaaatgtgtttttaaaacagtggtatcactaaatattaagttagatgtgtttatgtgcttaatgaatttatattttagaatgttataagttgtatatagtcaaatatgtaataaattttattttttaggtctttctcattaaggtattttaattttgggtcccttttccagagtgactctagctcatgatgagttgacataaaaactaaacagtacaaaatgtacattgcattcagtattgcacttgatctttgcactgaagtttgagtcagttcatacatttagtacttgggaagtacattaagctaactttcattgctctggcaaaatgctcgataagataagagtctattgtggaaagccatggcagcaggaaagtaagactgctgatgatgtttaatccatagtcaagacgcagaaggagatgaatgctggtatccaacattttttgctgttcattttctctagaaccctagtccataaagatgtatgacttgcattcaaaatgcgtccccttcagttgttcaacttttctgtaaatatcctttcaggcatgtctagaagattgtttcgcaaatacttctcaatccattcaagttgatagtgcagattaatcactgcagaataaaagcctgtaacttggctcacgtgccaaggaatatgcacactcctgacacatcaataagtaaatcaaagtgtagcttttgcctttaacattgccagacttatgtaatgttctgcacgttcttcctccatcactttttattctaatggtgtttccttgacattgaatcacgctgtggaagctgcttagaattaacattgaaatctactgatatatttatgatgcagcaatttagatttactattttacttagaattttttataattgagagaatataatattttcacagttatctatctgctgtaaatagaggattttaaaaaaaatctctataacttttttttacaacacacagtaaaattaagttaaaatttaataaagtcactatgttgatttcaaagtgtgctacgcccacggtggtcacgcaggtgtagcagaagatgccactaaggtgggctaaggccgatgggttggggtctgcgctccctggagatgagccccaggcggttccctggcaatcagctgcgatcatgatgcccgatgagccannnnnnnnnnnnnnnnnnnnnnnnnnnnnnnnnnnnnnnnnnnnnnnnnnnnnnnnnnnnnnnnctgggtgactttatggaaagaatttgatagatttcatgatgtagaagaattttattaggcttattttacaggagactaagaccctgggacctaaagatatctgggtcctgagaatcaggaaatgggtagagacgtggttgatggtatgagacagattttagagaactcttagatcatgggcaatgaccgcaatctgatgcttagaatagatcatctataaacaattatgctgttctttttctttctgttgtatgatctgatgatgtagcccccttgccaagttccctgatcccccttgccaagttccctgattgtaacagtatataagcattgcttgagagcatattcaactacattgagtgtgtctgtctgtcatttcctcgccgattcctgatttctccttgagccttttcccttgttctccctcggtcggtggtctccacgagaggcggtccgtggcaaaagtgtataaatgttctaaaacatttgaactctaaaacatgcaaaatgaaaaattaaaataaataaacatgaaaattaaaatatattagctgctaaaagttaaacaatactatataatattttgttattagaattcaaaatcacattagttggatttaatttgaacattgcattctttcaataataatttcaataaaaaaagtttccccatgatagtagaaaataataacatatgtatctatctatttatttaactacacatatatagcatttgtttcaactaaaataaatgaatgagcaaagcacctaagtaattggtgtctattatatttatgaagccaatagtttcaaataaattatcatgcataaggaggtattgcaaatgttaaaccttttttgaaacagatattcccagttacagaaattataatttctaatctttcctataagtagaatgatgataattaatataggccatttgtaaataatgttcagattaaaatattctctatttcactagagaagaatgatattaaatgtattatattttatttcccattttgtttgcaccactattctatatccctcagcagtttaaatttgtttcaccatatgtgtgtgtgtttgtatcttaaatatggcactaaaattagaataatttaatataaatctttaggagaaaagatattgaattattttatgttgataggaaaatatcttttaattgtccaagaatactttttcttctattttaggactgatcagacccaggactaatattttatatgtactaattctatgtaccaaaatatgttattatctcatgaattctgtctcaatattgaggtaataaaaatagtccatcatgaactttaaaattaaaataatgattaattaatttttattcatattttgtttgtatgaatggttatacatcacatgtgtgcctggtgactgtgaatgtcaggagaaggtatgaaagccactggaattggaataagagataatatttgagatgttatgtgggtgctgagaattagacgcaagccatcttcaagaatagccagcatactataccactgagtaatccattcatccctcaataattatctttgtagacagtaaatatatttctaaactataaatgaccagaaaaattaatgtattattaatgaagacattcatctcatgtgacacacttcacctgtctaaatcagtaacactctctccactaattaagattttctaagtgcatgacacttactatttctaaagctgtccaatgggggccagtccccagtcagcacccagtgagataatccatgaatgcatttatatcttaggaaaaattcttatctatgtagtatttagaacattttcatgtgaggggataaacaaggaagcacagatgctttctgatagaaactttctctttaattcatctagaaaaaaaaaacctctcaggaaaatctctcttgctctcctcccaatgctctattcagcatcttctccctacttaattctagatctttttctctatgcctccttgctgctgccctgctggctctgctctatgcctccccatgtcacttttctttgctatctcaccgttaccttctctgcctcactctctgccttcttctctgcttctcacatggccaggctctggacaattatagttatatgttacattctcataacacatgatatgtcacatagtttctctcaggctagggatatcacaatgactggccaatgagcaagtggccttgcatgtagctctaagttggtgatggttcccagacagtaagtagccatttggttgaaatttgaggttgggtagtacatgaagactgaattttcttcaaactctggccttgaaatagtaaaacaacacctatgaaaatgacgacctgtatttgtctttagaggcaaccacatattgtctgcagggcctgctttgaatttgctctgaagttagcttgtttgtgtaaaaggaagaatcctatatcagcctgagaaatgtaaaatatcctagcatttcaagtcatcaaaattatatggagagtataaatcatccttctgactattcatagtcatatttgtgtccaccaagtataaaacacactaccaaagggctgtggaaaaaatcgccataactgttcttattagggaggcatagcagtggtacctgaggaagttacagcaacaaccagtcatccagtcaataaccccatggctttgccacttggaggtacccaataatgtttggctttgccgagtaggactccaacaaattcagagggtcaatttttaaatgctggttgtcactgctgaacagtcccattgccctctgcataattccacaatggaaagctttttacactgattgccaatcattaaacagcctactcagcataaacaggtatgatattattctgcattttgttacattactagatgaattcctatttcttcctacaatagtggaactgaaaaaagatacacaatcatactacccctctactaatcttatgacttatatcatttcaattttcagaccataatgcaaactattgaccaaaacatgtgaagatgaaaaatagaaatgtagaataatattacatataaaaagaaaaggcggacttattttgttttatttcttagcatgcatagcaatacatgatttgaggtttatataataaagggacaataaatcttcaagaaacttacccctactgaattaaaatattaaagaaggtcacacatttactcaaatatattagactactgggcaaatagacatgaaaagtagagttaatattgaggtaggccttctgtgaaatgtctaaggaaattatgtttcatacagtgtgtaaccaagtgggaatcatatcagaaagcagtcaaaagcttatattacaagtaacagatgcttggttatatgacctcccagagcttgactgtctatacacaaaaagtggtgttaataaaactgtaatttgggctatgtttttttaaatggcttcaccaacatgaaaggaagggaatgagcatgtcatggatgcttagagattatgcttccagcaagaagaattgagctttggctcttattacagaaacatgacaaggtgtgagttttatttattagaaattatataatattttaagctggggactaaaaattttattgaaacaaacaggcaagggataggcatgtactagaagcaaaaataggatgtcaatgctgtaatgttattttttggaccaaaatagtatttcctatagaaatgacaatgatcttaggttattattcttcataaagatgacaagttcacaagatatcctagttcattaaaatcgttttagtcatttaatagagtgctgtgatagattacacaaaggaaagcacttacgatgagaaataatgatatccacaattattttcttaattcttagaaacattctattgttatatctcaatctcagaagccacttattgctttattattgaaacatatgaaattgtaagttatatattgtctatggtgacatttcaaagaacatgtgacgtacagtgtagcacagataaagaacataactgcagctgaatcagtaactaaacttacatacattaaatctgccatgttggcaacagtgtgtgcactaccaaaggatgtactaatgctcacgacactcccctatgtcaccctttgttcatcattacatcataggtctattttgtttgcttttgaaatctagaccaagtcttttgtgtctttccaagcacagagctcattaatttacctcatagacttgttaaacttcttctggttcatcaattgaatagaaatactcactactaattatgtgagaccctgccagtaccatagcacatggataatttttacataaaacatgcatacaagtaagattattcagactgaacatgaattttagagaaatcaggaaggagtatatgggagtggttggagtgagactagagaaatgtaattaaactataatctcaatacaaagatctactaagcaaaaaacatgaaacattgtcattcaagtgaaacatcagtcttcaaattggaaagatatttttactaggaaaatgtctggtagatggttattatctagaaaacacaaaaattagaaaacggtaaactttaataaaaagaataatacaatgagactacatgaaaagttcttaactaatgaaacaaatatcttgaaacttttttcttaaaagtttaatatcaataaccatcatggaaattcaaattaaaactatttacatattacccctgaaataataactaatacccaataaaaataatataaacaaaaaatggcaatgcatgccatcatggatttgggagagagaatgttcattgcagttctgaatggatactggtgccaccacggtgaaaatctctgtataggtccttccaaaagctgaaaatagacatatcacaagacctgccacacatttttcaagcaaatacccaaaggactctacctgactgcagagacactttctcataaaatattattgttgatctattcataatatctggaaaatagaaacagccaagatgcccatcaactgattaatagatgataaaattattgtacatttcagtgtaatattattcagtttttaagaaaaatgaaattatgtaataagcatgtaaatggatatatcttgaaacaaccattccccattatattacctaaacattgaaagtccaaaatcatatgatctttttagtggatctactaatcttttgctatatgtattttattgaactacccatggatgtgagataattggtaacaacagcacatgggagagcatgggatcattcaaggaagattagagagaatgcattttttaggagataatggaggagcaatagaaaggattaaatgaggttactgatgaaagtgatggttagagaaggcaatatgaggagggataactagcacttagggccttttgaaaaagacatagagaaaatactattgtagaaacttcctataattggtgtatagttatatacaccaaagagctcagatggagttaccctataatggaaatattaactactttttatcactgtgataaaacatcctgaacagagcaacatagattgggaagcatttactttggcttacagttctaacgggataaaaattcatgatgaaagaatgaatatgtcagcaaacagcagtagcaatggcctgagaagcaggtgagagctcacatcttgaagtgtaagaatgtagcagagagaacaaactgcaaatgaccagaaaatgcttttggatcagagcccatacccctctgactgacttctccagaaattctgaacaaataaaactccccaaacagagccataactgaaggtccagtgtctgagactactaggggtatttcttattcaaaccactacaatggggtggggggagcaatcctccaagtaggcactacacacagacaaataaaaactctagtaactggaatggattgacttatttgaattacttgccagtggagctacatagagcacaattattgtatttaaattaccctttatgatcttacaaaacttgacagtaagatcatattgctaaagaaaccacatatttgaatcagggaacatggtgatatctagttgttcttcaactggaaacttcatgctttctgcccagcattcatgttgctggaaagagcaatgtacactaccagtgtagaaattaaatcatcaatcttatcaagatgtggatcctataagttacaataaaaattagcctgataagatatccccaccagaagaatattcacataaatgctatgggagcaacaagctattttctaaattagctttaatcctattctacaagagagaatccatatctagaatagttatagggatcaagaacccatggcttgattggtcataggcccaatgggagatcctaatattattgttctacaaaatgaaaataactcctaatgacttgttgctgcagtaataagttagtatgttgctcaactctcacaagagaagttttgtcttacaataaatggcaattaaagcagccccacaagatttatatcataccgatctcctcatggcctatgcatctagaagctaggaaacaaagaggaccctaagagagacatacatggtccccctggagaaggggaagggggcaagacctccaaagctaattgggagcatgggggaggggagagggagttagaagaaagagaaggggataaaaggagggagaggaggacaagagagagaaggaagatctagtcaagagaagatagaggagagcaagaaaagagataccatagtagagggagccttgtatgtttaaatagaaaactggcactagggaattgtccaaagatccacaaggtccaactaataatctaagcaatagtcgagaggctaccttaaaagcctttctctgataatgagattgatgactaccttatataccatcctagagccttcatccagtagctgatggaagcagaagcagacatctacagctaaacactgagctagttgcagacagggaggagtgatgagcaaagtcaagaccaggctggagaaacacacagaaacagcagacctgaaaaaaatgttgcacatggaccccagactgatagctgggagtccagcataggacttttctagaaaccctgaatgaggatatcagtttggaggtctggttaatctatggggacactggtagtggatcaatatttatccctagttcatgactggaatttgggtacccattccacatggaggaattctctgtcagcctagacacatgggggaggttctaggtcctgctccaaataatgtgttagactttgaagaactcccttgagaagactcaccctccctggggagcagaaaggggatgggatgagggttggtgagggacaggagaggaggggagggtgagggaactgggattgacaagtaaatgatgcttgtttctaatttaaatgaataaaggaaaagtaaaagaagaaaagaaaacaggccaaaagattataaaagacagaggtggtgggtgactataaagaaacactattatctaaataaaaatatgtcagaagcacacatgaacttatagtgtttatgaaagtatgtataataactacataatctcaagccaagaaaaaaatatcatctttcagtgatgaaggtgattttatttctcccagaattaaagccaaagacctaatgaaagtaattatcttcaaaaggttgaaaatacatactttgcaatacacagatctgcctagaaatctcatgttcacaatacacatgatgctcaattgaattccattcaatgttacagtttagataaacagtttgtagataaactcacaatgtatcatttctttttattttttgaccaaacagcttctcatctgttattcagaataattcctcgatggcaggatatccatcccaattgggggaaggggagaatttgaagaaaacctagaccacatacatatttgccattgggaaacaaagtctaaaatgatgttgttcacatcttctctactagtcctctccccgtcccaaagaaccttggtatatgtgcctcattttacagagagaggaaagcaggaactgagcatcccttacttgccatcctcaacccaaaatttgcatcattgctcagctctgcccttctcatatgacagttacaagtcaaggcttccaaagtccctctgtcatgtttggtgtcaatagtttatacagatgacttcatgtcttcatatctaatgtcttatatagattaatattaaacaatgttatttctctaaccacattttaaattaatttaaaaatccattaattgtgtctataaaatgcagacagagtgctgagacacaatataagcctgatgatctgaatttgaaactcacacccaccacatggagaatcaacttccaaaaattttcctattacttccacacttacaccattgtacaaacacaataataatgaacaaaatgaaatgaaataaaaaattaagtctctgtaggtaatgctactgtgcagcaaaagtaaaaatggcagcttaagcttgctttatggttacactttaccatcttccattaattataaggacttcaatcatggcagaactatgctgttattgtctcagtgtaacctaaccaggtgttccagatgttcttaatgtggacacctaaactatttgatatttgggttaagatctttccctctttcagaagaaacctcaggacagagggaatcttgtcttttaattttgagtctgtagactttttccatttcaaatatacatgaaacaagtgatgaagaaaattaatcaaaaggtgggaattgcaatgatattaggttcaatattaagcttcaatattatcatggaatcgcctgttatacactgagtgtttggcaataagggatttttagaagaaggagtttttattctcaacaggttccttaagtttagctcaaataaatctaagcaatccactctagaattaaatagtttcctaagggcacagctatgaatagagctcaatttacatataaaattttgttcaccatttatgtcattccagttttcattagtacaaggaaaatacaaaatatttagatgtcaatatcaagtgaatagttcatctccttttttaatatatatcacctaaatcaccattttctcagaaaaatctggcctgaagttctgtctggaacttcaacatgaaaaatatgcacagcttgctattataaatcctagttgatttttaagattcatgtctggtgtctgactcagaggggccagaggctagacaaatattttttgaatcttcattgtgaagatttttaatgattattttaatataaataacaaagatgatggataatgtaactttgtacagttcatagacgctgaactactttgtgcttaaaatgttagttccctatcataaatgataggtgataagtgtatgtttaatactttccctctgagctatattcatgtactagagaattattttaaacatgaaaagactgtgtttatagtctcagctcctgagaactggtccaaccttaggcaggtgaatgccaggagcaacgtttttcttctacagaggatgctttgctgccaagcaacctggttgtgtggaaatgttccttttttaatcaagtttaaagggtcttcatcatgctgttgctccacatattttcaggttagagcttggtccttggagtattatcttttaccagaaaattcatagtattctttcaataactaacaactaaacttttcgataaaaaagaattggaatttcaattttaaagcctgagtaaaattcttgtgaatcaggatattttattttaagtcttatcttttaaaaagttattttattttttaaaaaattataatatactttcataatttccctccttcacttttctttacaaacacttctatagatcaccatgtgtttttttttttacatttatggcctctttctgttcattgttattacatacaaatagtcttgcctatagaagaacaccacaatttgttacctgataacaaattatcaacccttaaaacctacaaactattgatattactgaaaagactatacttatagatgtaaagatatatgtgtgtgcacatatatagatacacatatatgtaggatttttaattttagattttagacatcaaaattatttatatgactgagaaactagacactataaatgagcattcagtattcaacaccgtgattttagatattgtcacaatgacagaaaattttcttatagaaaattttaagttttgtgattgctctgtgcacttagtgaagtctcacagaaaaagaatcatagtatttttagtttataataaaaagtacatataattaaaatggttggcacaaaacaacatttgagcatttttcctatttactatcaagtagtatcattttgaaataataatttgactagtttcaaaaatgaaaacaaaatttaaactaaatgcctaatctagcctgataacatttttatgaatgaaattattcaatagtgttatcaattaggggcccaaaacttttcctaaaataaaacttttaatttttttccatttttatttaaattagaaacaaaattgttttacatgtaaatcagagtttcctcaccctccccttctccctgtccctcactaacaccctacttgtcccataccatttctgctccccagggagggtgaggccttccatggggaaacttcagagtctgtctatcctttcggatagggcctaggccctcacccatttgtctaggctaaggctcacaaagtttactcctatgctagtgataagtactgatctactacaagagacaccatagatttcctaggcttcctcactgacacccatgttcatggggtctggaacaatcatatgctagtttcctaggtatcagtctggggaccatgagctcccccttgttcaggtcaactgtttctgtgggtttcaccaccctggtcttgactgctttgctcatcactcctccctttctgtaactgggttccagtacaattccgtgtttagctgtgggtgtctacttctactttcatcagcttctgggatggagcctctaggatagcatacaattagtcatcatctcattatcagggaagggcatttaaagtagcctctccattgttgcttggattgttagttggtgtcatctttgtagatctctggacatttccctagtgccagatatctctttaaacctacaagactacctctattatggtatctcttttcttgctctcgtctattcttccagacaaaatcttcctgctcccttatattttcctctcccctcctcttctccccttctcattctcctagatccatcttcccttcccccatgctcccaagagagatgttgctcaggagatcttgttccttaacccttttcttggggatctgtctctcttagggttgtccttgtttcctagcttctctggaagtgtggattgtaagctggtaatcatttgctccatgtctaaaatccatatatgagtgatgtttgtctttttgtgactgggttacctcactcaaaatggtttcttccatatgtctgtggatttcaatagcacaaacaacatacagtatcttggggcaacactaaccaaacaagtgaaagaccagtatagcaagaactttgagtttaaagaaagaaattaaagaagataccagaaaatggaaagatctcccatgctctttgataggcagaatcaacatagtaaaaatggcaatcttgccaaaatccatctacagactcaatgcaatccccattaaataccagcacacttcttcacagacctgaaagaataatacttaactttatatggagaaacaaaagacccaggataggccaaacaaccctgtacaatgaaggcacttccagaggcatccccatccctgacttcaagctctattatagagtaataatcctgaaaacagcttggtaatggcacaaaaatagacaggtagaccaatggaattgagttgaaaaccctgatattaacccacatatctatgaacacctgactttgacaaagaagctaaggttatacaatgtaagaaagaaagcatcttcaacaaatcgtgctggcataactggatgctggcatgtagaagactgcagatagatccatgtctaatgccatgcacaaaacttaagtccaaatggatcaaaaacctcaacataaatccagccacactgaacctcatagaagagaaagtgggaagtatccttgaataaattggtacaggagaccacatcttgaacttaacaccagtagcacagacaatcagatcaataatcaataaatgggacctcctgaaactgagaagcttctgtaaggcaatggataagtcaacaggacaaaatggcagcccacggaatgggaaaagatattcaccaatcctatatctgacagagggctgctctctatttgcaaagaacacaataagctagtttttaaaacaccaattaatccgattataaagttgggtagagaactaaataaagaattgttaacagagcaatctaacttggcagaaagacacataagaaagtgctcaccat

SEQ ID NO: 12 - DNA, 13515 bp, Cricetulus griseus
tctagaaacaaaaccaaaaatattaagtcaggcttggcttcaggtgctggggtggagtgctgacaaaaatacacaaattcctggctttctaaggctttttcggggattcaggtattgggtgatggtagaataaaaatctgaaacataggtgatgtatctgccatactgcatgggtgtgtatgtgtgtgtatgtgtgtctgtgtgtgtgcccagacagaaataccatgaaggaaaaaaacacttcaaagacaggagagaagagtgacctgggaaggactccccaatgagatgagaactgagcacatgccagaggaggtgaggactgaaccattcaacacaagtggtgaatagtcctgcagacacagagagggccagaagcactcagaactccagggggtcaggagtggttctctggaggcttctgcccttggaggttcctgaggaggaggcttccatattgaaaatgtagttagtggccgtttccattagtacagtgactagagagagctgagggaccactggactgaggcctagatgctcagtcagatggccatgaaagcctagacaagcacttccgggtggaaaggaaacagcaggtgtgaggggtcaggggcaagttagtgggagaggtcttccagatgaagtagcaggaacggagacgcactggatggccccacttgtcaaccagcaaaagcttggatcttgttctaagaggccagggacatgacaagggtgatctcggtttttaaaaggctttgtgttacctaatcacttctattagtcagatactttgtaacacaaatgagtacttggcctgtattttagaaacttctgggatcctgaaaaaacacaatgacattctggctgcaacacctggagactcccagccaggccctggacccgggtccattcatgcaaatactcagggacagattcttcactaggtactgatgagctgtcttggatgcaaatgtggcctcttcattttactacaagtcaccatgagtcaggaggtgctgtttgcacagtgtgactaagtgatggagtgttgactgcagccattcccggccccagcttgtgagagagatccttttaaattgaaagtaagctcaaagttaccacgaagccacacatgtataaactgtgtgaataatctgtgcacatacacaaaccatgtgaataatctgtgtacatgtataaactgtgtgaataatctgtgtgcagcctttccttacctactaccttccagtgatcaggtttggactgcctgtgtgctactggaccctgaatgtccccaccgctgtcccctgtcttttacgattctgacatttttaataaattcagcggcttcccctctgctctgtgcctagctataccttggtactctgcattttggtttctgtgacatttctctgtgactctgctacattctcagatgacatgtgacacagaaggtgttccctctggagacatgtgatgtccctgtcattagtggaatcagatgcccccaaactgttgtccagtgtttgggaaagtgacacgtgaaggaggatcaggaaaagaggggtggaaatcaagatgtgtctgagtatctcatgtccctgagtggtccaggctgctgacttcactcccccaagtgagggaggccatggtgagtacacacacctcacacatactatatccaacacacacacacacacacacacacacacgcacgcacgcacgcacgcacgcacacatgcacacacacgaactacatttcacaaaccacatacgcatattacaccccaaacgtatcacctatacataccacacatacacacccctccacacatcacacacataccacacccacacacagcacacacatacataggcacacattcacacaccacacatatacatttgtgtatgcatacatgcatacacacacaggcacacagacaccacacacatgcattgtgtacgcacacatgcatacacacacataggcacacattgagcacacacatacatttgtgtacgcacactacatagacatatatgcatttgtatatgcacacatgcatgcacacatacataggcacacatagagcacacacatacatttgtgtatgcacacatgcacacaccaatcacatgggaagactcaggttcttcactaaggttcacatgaacttagcagttcctggttatctcgtgaaacttggaagattgctgtggagaagaggaagcgttggcttgagccctggcagcaattaaccccgcccagaagaagtaggtttaaaaatgagagggtctcaatgtggaacccgcagggcgccagttcagagaagagacctacccaagccaactgagagcaaaggcagagggatgaacctgggatgtagtttgaacctctgtaccagctgggcttcatgctattttgttatatctttattaaatattcttttagttttatgtgcgtgaataccttgcttgcataaatgtatgggcactgtatgtgttcttggtgccggtggaggccaggagagggcatggatcctccggagctggcgtttgagacagttgtgacccacagtgtggggtctgggaactgggtcttagtgttccgcaagtgcagctggggctcttaacctctgagccatccctccagcttcaagaaacttattttcttaggacatgggggaagggatccagggctttaggcttgtttgttcagcaaatactcttttcgtgtattttgaattttattttattttacttttttgggatagaatcacattctgcagctcaggctgggcctgaactcatcaaaatcctcctgtctcagtctaccaggtgataagattactgatgtgagcctggctttgacaagcactttagagtccccagcccttctggacacttgttccaagtataatatatatatatatatatatatatatatatatatatatatatattgtgtgtgtgtgtttgtgtgtgtatgagacacttgctctaagggtatcatatatatccttgatttgcttttaatttattttttaattaaaaatgattagctacatgtcacctgtatgcgtctgtatcatctatatatccttccttccttctctctctttctctcttcttcttctcacccccaagcatctattttcaaatccttgtgccgaggagatgccaagagtctcgttgggggagatggtgagggggcgatacaggggaagagcaggaggaaagggggacagactggtgtgggtctttggagagctcaggagaatagcagcgatcttccctgtccctggtgtcacctcttacagccaacaccattttgtggcctggcagaagagttgtcaagctggtcgcaggtctgccacacaaccccaatctggccccaagaaaaggcacctgtgtgtgactctggggttaaaggcgctgcctggtcgtctccagctggacttgaaactcccgtttaataaagagttctgcaaaataatacccgcagagtcacagtgccaggttcccgtgctttcctgaagcgccaggcacgggttccctaggaaatggggccttgcttgccaagctcccacggcttgccctgcaaacggcctgaatgatctggcactctgcgttgccactgggatgaaatggaaaaaagaaaaagaagaagtgtctctggaagcgggcgcgctcacacaaacccgcaacgattgtgtaaacactctccattgagaatctggagtgcggttgccctctactggggagctgaagacagctagtgggggcggggggaggaccgtgctagcatccttccacggtgctcgctggctgtggtgcatgccgggaaccgaaacgcggaactaaagtcaagtcttgctttggtggaactgacaatcaacgaaatcacttcgattgttttcctctttttactggaattcttggatttgatagatgggggaggatcagagggggaggggaggggcggggagacggagggaggaggggaggaggggaggaggggaggaggggaggaggggaagggatggaggaaaatactaacttttctaattcaacatgacaaagattcggagaaagtgcaccgctagtgaccgggaggaggaatgccctattgggcattatattccctgtcgtctaatggaatcaaactcttggttccagcaccaaggattctgagcctatcctattcaagacagtaactacagcccacacggaagaggctatacaactgaagaaataaaattttcactttatttcatttctgtgactgcatgttcacatgtagagagccacctgtgtctaggggctgatgtgctgggcagtagagttctgagcccgttaactggaacaacccagaactcccaccacagttagagcttgctgagagagggaggcccttggtgagatttctttgtgtatttatttagagacagggtctcatactgtagtccaagctagcctccagctcacagaaattctcctgttccggtttccaaagtactggagttatgagtgtgtgttaattgaacgctaagaatttgctgattgaagaaaacctcaagtgggtttggctaatccccacgaccccagaggctgaggcaggaggaatgagagaattcaaggtttgccagagccacagggtgagctcaatgtggagactgtgagggtgagctcaatgtggagactgtgagggtgagctcaatgtggagactgtgagggtgagctcaatgtggagactgtgagggtgagctcaatgtggagactgtgagggtgagctcaatgtggagacctgtatcaagataataatagtagtagtaacaatgcaggcgagggtgtggttgagtggtagagcagttagttgatttgacatgcttgaggtctcccggtccatctgtggccctgcaacaggaagggagggaggaagggggggaacgagagagaggaaagagagacagaagctaagatagggaatgagagaggaaggaagaaacgggaagaaattcagactccttcctgagttccgccaacgcctagtgacatcctgtgcacaccctaaggtggcctttgtgtggcactggcttgggtggtcgggaaaggcattttcagcttgttgcagaactgccacagtagcatgctgggtccgtgaaagtttctgcccgttaacaagaagtctctactacttgtgacctcaccagtgaaaatttctttaattgtctcctggtgttctgggttttgcatttttgtttctaaggatacattcctgggtgatgtcatgaagtccccaaagacacagtggggctgtgttggattgggaaagatgatttatctggggtgtcaaaaggaaaagaagggaaacaggcacttgggaaaatgtcctcccgcccacccgaattttggcttggcaaccgtggtggaggagcaagaaacacgtggacgtttgaggaggcatggggtcctaggaggacaggaagcagaaggagagagctgggctgacagcctgcaggcattgcacagtttcagaaggagattacagcatgactgagtttttagggatccaacagggacctgggtagagattctgtgggctctgaggcaacttgacctcagccagatggtatttgaataacctgctcttagagggaaaacagacatagcaaacagagccacgtttagtgatgaaactctcactttgcctgagtcatgtgcggccatgcccaggggtcaggctgacactcaactcaaaaacaagtgagaaattgaagacaatccgtggtggcagctactggaagggccaccacatccccagaaagagtggagctgctaaaaagccatttgtgataggcacagttatcttgaatgcatggagcagagattacggaaaaatcgagaatgttaatgaggcaacattcgagttgagtcattcagtgtgggaaacccagacgcttccatcccctaaaaggaacatcttgctctcagtcaaaatggaaataaaaattggggcttgaatttggcaaatgattcagaactctgtgtaggtattttcacacgcacagtggataattttcatgttggagtttatttgtgctaaaaggcagaaaagggtaaaaagcacatcttaagagttatgaggttctacgaataaaaataatgttacttacagctattccttaattagtacccccttccacctgtggtaatttcctgagatagtcagtggggaaaagatctctccttctcttctttctccccctcccctcctctccctccctccctccctccctccctcctctccctccctccccctttccttctttctttgctccttctcctctgcctccttctccctttcttcttcatttattctaagtagcttttaacagcacaccaattacctgtgtataacgggaaaacacaggctcaagcagcttagagaagattgatctgtgttcactagcgtgcaattcagaggtgggtgaagataaaaggcaaacatttgaggccatttccttatttggcacggcacttaggaagtggaacatgcctaatctactggtttgtaccacctttccctataatggactgtttgggaagctcctgggcaaccgattctggcatctcattggtcagaggcctgttaaatggtactcttatttgcaaagaaggctgtaacttgtagctttaaaagcctctcctcaagaaagaagggagaaaggatatggctagacatatctaatagacttaaccactgtgaaaagccttagtatgaatcagatagaacctatttttaactcagttttgaaaaaaataatctttatatttatttgtgtgtgtgtgtgtgtgtgtgtgtgtgtgtgtgtgtgtgtgtgtgtgaaccacatgtagcaggtgctggaggaggccagaagagggcaccagatctcctggaactgacaccacacatggttatgagctgcctgatgtgggtgctgggaactgaactctcgtgttctgcaagagcagcaactgttctcttaactgatgagccatctctccagccccccccataattttaattgttcattttagtaaattttattcataatcaattatcacagtataaaacaatgattttatatatatcatatacatatcaaggatgacagtgagggggatatgtgtgtgtgtgtgtgtgtgtgtgtgtgtgtgtgtgtgtgttatttgtgtgtgtgctttttaagaaggtgccatagtcactgcatttctctgaaggatttcaaaggaatgagacatgtctgtctgccaggaaccctatcttcctctttgggaatctgacccaaatgaggtattctgaggaactgaatgaagagctcaagtagcagtgtcttaaacccaaatgtgctgtctagagaaagtcaacgtcatcagtgagctgaggagagatttactgagcggaagacaagcgctctttgatttaagtggctcgaacagtcacggctgtggagtggagcctgtgctcaggtctgaggcagtctttgctagccagctgtgatgagcagtgaagaaagggtggagatggaggcagggtgggagcagggctatggttcagactaggtatcgtgagcacaccagctggttgacttgtggtctgtgggtcaggcgttgtaaacgccctcagggtcaggcagtcacattgcttgaagctgaatgggtgaggcaacacagagagtgcaaagaaggcaaagtaccacctcttccccgacccaggtcacttctgggttatagctgagactccggacagcatgcaaccagctggttagagcttcagggaaaacttgatgtctgcatgttgctatgaaatgtgattcggtacatctggagaaaatttataatgctggctcagtcaagcactgaacaaaggtaccttggctttgggagctacatgacattgacttgtaggcagacttttttttttctgcccgccaattcccagataaccaatatggaggctcaatattaattataaatgctcggctgatagctcaggcttgttactagctaactcttccaacttaaatgaacccatttctattatctacattctgccacgtgactttaccttgtacttcctgtttcctctccttgtctgactctgcccttctgcttcccagagtccttagtctggttctcctgcctaaccttatcctgcccagctgctgaccaagcatttataattaatattaagtctcccagtgagactctcatccagggaggacttgggtgctcccccctcctcattgccatccgtgtcttcctcttccctcgcttccccctcctcttcctgctcttcctcctccacccctcctttcatagtattgatggcaagggtgttctagaatggaggagtgcccataggcatgcaaagaaaccagttaggatgctctgtgaggggttgtaatcataagcgatggacacaattcaagccacagagtgaagacggaaggatgcactgtgctctagagcaacttctggggcagaatcacagggtgagtttctgacttgagggcgaagaggccacgaggaagggagtgagtttgtctgagctagaagctacggcccacctcttggtagcagacctgcccacaagcatgctttgttaatcatgtgggatctgattttcctctaaatctatgttcaactcttaagaaaatgtgaattctcacattaaaatttagatatacgtcttttggtggggggggtgtaaaaaatcctcaagaatatggatttctgggggccggagagatggctcagaggttaagagaactggttgctcttctagacattctgagttcaattcccagcaaccacatggtggctcacaaccatctgtaatgcgacctggtgccatcttctgacatgcatggatacatgcaggcagaaagctgtatacatagtaaattgataaatctttttttaaaaagagtatggattctgccgggtgttggtggcgcacgcctttaatcccagcactctggaggcagaggcaggtggatctctgtgagttcgagaccagcctggtctataagagctagttccaggacagcctccaaagccacagagaaaccctgtctcgaaaaaccaaaaaaaaaaaaaaaaaaaaaaaaaaaaaaagagtatggattctaagaaagccgtaacagctggagctgtgtacggagttcagcgtggtactagaagaacagacattcatgatgaaacaccccaggatttttacttagtatctagtttccattgttgttttgagaccggctcttatgctctccaggctggcctcaaactgctgatcttcccgcctctacctctcaagtcctgggactacttggctcataaaacagtttttgtcgggctccctgaagttatggttgtacaaaccgtgggggtcaatatactcacttgggcagagagagaaggtctgaatcccagacaatgactgcatctcaggacagttgggaagaggacaatggcagaaggacttagaaaagatagactggagggtggaaaagcagcaggaacagagaaacaaaacaggaagcttgctatccagggccactctggagtcctgtggcaagatggaagcgggctaggggaatacatttgtgctactgtgtgtgtgtgtgtgtgtgtgtgtgtgtgtgtgtgtgatcaatgcctatcaatgttgaaggggaaatatgtataccacattgattctgggagcaattctcagtatctggcctagagaaaggaatggcccctgcagaatagacagagtgaatggtgccctttatcatttgctaaagtgaaggagaaataaacatccttccatagagtttcaggtaaatgaaccccacagttcatctgtgccgtggtggaggcctggccaacagttaaaaagattagacacggacaaagtctgaaggaaacacctcgaataggaagaggagagccacctcattctgtaactttcctcaaggggaagatgttccaagagtgggaataaatggtcaaaggggggatttttaattaggaaaacgatttcctgtatcacttgtgaaactggaggttgatttggggcataggacaatagatttgatgctttgcaaaaagctgtttcaaagcagagaaatggaatagagacaattatgtagcgaggagggagggtggggcgaagatggagacagagaagtggaagctgactttagggaagaggaacatagaccacaggggcggggcggggggcaggggcggggggcggggctcaaaggaggcagtgggaacgttgctagtgttcgcagcgtaagcgtgaatgtgcaagcgtctttgtggtgtgtgaccaggagtagcgtggctggcttgtgtgctgcttgtaatcccagtctttgaggtttccacactgttccacagtgggtgtgattttccctcggagagcatgagggctctgctttccccacatcctccccagcgttcgttggtatttgtttccaagatgttagtgggtgagacaaagcctctctgttgatttgcctttaacaggtgacaaaaaaagctcaaccaggagacatttttgccttcttggaaggtaatgctcccatgtagagcaatgggacccatctctaaggtgaggctactcttgcagtttgcacccagctcttctgatgcaggaaggaagttggtgggcaagcaagactgtttgcttcttgcgatggacacattctgcacacaaaggctcaggaggggagaaggctgtttgatgtttagcactcaggaaggcccctgatgcatctgtgattagctgtctccatctgtggagcagacacggactaactaaaaaccagtgtttttaaattgtcaagcctttaaggtgaggaaattgacttattgtgctgggccatacgtagagcaagtgctctgcattgggccaacccccggctctggtttctaggcaccagaatggcctagaactaactcacaatcctcccattccaggtctcaggtgctagaatgaaccactataccagcctgcctgcctgcctacctgccttcctaaattttaaatcatggggagtaggggagaatacacttatcttagttagggtttctattgctgtgaagagacaccatgagcatggcaactcttataaaggaaaacatttagttgggtggcagtttcagaggttttagtacattgtcatcatggctgggaacatgatggcatgcagacagacatggtgctggagaaagggatgagagtcctacatcttgcaggcaacaggacctcagctgagacactggctggtaccctgagcataggaaacctcacagcccaccctcacagtgacatatttccttcaacaaagccatacctcctaatagtgccactccctatgagatgacagggccaattacattcaaactgctataacactttaaagtattttatttttattattgtaaattatgtatgtagctgggtggtggcagccgaggtgcacgcctttaatcccagcacttgggaggcagaggcagatggatctctgtgagttcaagaccagcctggtctataagagctagttgcaaggaaggatatacaaagaacagttctaggatagccttcaaagccacagagaagtgctgtcttgaaaaccaaaaattgtgctgggacctgtctctgctttggttgcttcccactcccccagagctggactcttggtcaacactgaatcagctgcaaaataaactcctggattcctctcttgtaacaggagcccgaagtcaggcgcccacttgtcttctcgcaggattgccatagactttttctgtgtgcccaccattccagactgaagtagagatggcagtggcagagactgggaaggctgcaacgaaaacaggaagttattgcaccctgggaatagtctggaaatgaagcttcaaaacttgcttcatgttcagttgtacacagactcactcccaggttgactcacacgtgtaaatattcctgactatgtctgcactgcttttatctgatgcttccttcccaaaatgccaagtgtacaaggtgagggaatcacccttggattcagagcccagggtcgtcctccttaacctggacttgtctttctccggcagcctctgacacccctccccccattttctctatcagaaggtctgagcagagttggggcacgctcatgtcctgatacactccttgtcttcctgaagatctaacttctgacccagaaagatggctaaggtggtgaagtgtttgacatgaagacttggtcttaagaactggagcaggggaaaaaagtcggatgtggcagcatgtacccgaaatcccagaactggggaggtagagacggatgagtgcccggggctagctggctgctcagccagcctagctgaattgccaaattccaactcctattgaaaaacctttaccaaacaaacaaacaaacaaataataacaacaacaacaacaacaaactaccccatacaaggtgggcggctcttggctcttgaggaatgactcacccaaacccaaagcttgccacagctgttctctggcctaaatggggtgggggtggggcagagacagagacagagagagacatgacttcctgggctgggctgtgtgctctaggccaccaggaactttcctgtcttgctctctgtctggcacagccagagcaccagcacccagcaggtgcacacacctccctccgtgcttcttgagcaaacacaggtgccttggtctgtctattgaaccggagtaagttcttgcagatgtatgcatggaaacaacattgtcctggttttatttctactgttgtgataaaaaccggggaactccaggaagcagctgaggcagaggcaaatgcaaggaatgctgcctcctagcttgctccccatggcttgccgggcctgctttctgcaagcccttctctccccattggcatgcctgacatgaacagcgtttgaaatgctctcaaatgtcactttcaaagaaggcttctctgatcttgctaactaaatcagaccatgtttcaccgtgcattatctttctgctgtctgtctgtctgtctgtctgtctatctgtctatcatctatcaatcatctatctatctatcttctatttatctacctatcattcaatcatctatcttctaactagttatcatttatttatttgtttacttactttttttatttgagacagtatttctctgagtgacagccttggctgtcctggaacccattctgtaaccaggctgtcctcaaactcacagagatccaactgcctctgcctctctggtgctggggttaaagacgtgcaccaccaacgccccgctctatcatctatttatgtacttattattcagtcattatctatcctctaactatccatcatctgtctatccatcatctatctatctatctatctatctatctatctatctatcatccatctataatcaattg

What is claimed is:

1. A method for generating and high throughput screening a library of targeted integration (TI) host cells expressing at least one sequence of interest (SOI) comprising:
   a) generating a library of TI host cells, wherein said library comprises a plurality of TI host cells expressing one or more SOIs, by:
      i) providing a plurality of TI host cells;
      ii) contacting the plurality of TI host cells with a plurality of vectors, wherein the vectors comprise one or more SOIs;
      iii) introducing the one or more SOIs into a locus of the genome of the one or more of the plurality of TI host cells wherein the locus is at least about 90% homologous to the sequence of NW 006874047.1;
   b) separating said library into single clones; and
   c) screening the clones for a specific cellular or product attribute.

2. The method of claim 1, wherein the one or more SOIs are introduced into one or more of the plurality of TI host cells by recombinase-mediated integration or gene editing-mediated integration.

3. The method of claim 1, wherein the one or more SOIs are operably linked to one or more regulatable promoters.

4. The method of claim 1, wherein the TI host cells are mammalian host cells.

5. The method of claim 1, wherein the SOI encodes a single chain antibody, an antibody light chain, an antibody heavy chain, a single-chain Fv fragment (scFv), or an Fc fusion protein.

6. The method of claim 1, wherein the specific cellular attribute is selected from: cell growth, cell titer, specific productivity, volumetric productivity, clone stability.

7. The method of claim 1, wherein the specific product attribute is selected from: level of glycosylation, level of charge variance, reduced mismatch, reduced protein/peptide aggregation, protein sequence heterogeneity.

8. A method for generating and high throughput screening a library of targeted integration (TI) host cells expressing at least one sequence of interest (SOI) comprising:
   a) generating a library of TI host cells, wherein said library comprises a plurality of TI host cells expressing one or more SOIs, by:
      i) providing a plurality of TI host cells;
      ii) contacting the plurality of TI host cells with a plurality of vectors, wherein the vectors comprise one or more SOIs;
      iii) introducing the one or more SOIs into a locus of the genome of the one or more of the plurality of TI host cells wherein the locus is at least about 90% homologous to the sequence of NW 006884592.1;
   b) separating said library into single clones; and
   c) screening the clones for a specific cellular or product attribute.

9. The method of claim 8, wherein the one or more SOIs are introduced into one or more of the plurality of TI host cells by recombinase-mediated integration or gene editing-mediated integration.

10. The method of claim 8, wherein the one or more SOIs are operably linked to one or more regulatable promoters.

11. The method of claim 8, wherein the TI host cells are mammalian host cells.

12. The method of claim 8, wherein the SOI encodes a single chain antibody, an antibody light chain, an antibody heavy chain, a single-chain Fv fragment (scFv), or an Fc fusion protein.

13. The method of claim 8, wherein the specific cellular attribute is selected from: cell growth, cell titer, specific productivity, volumetric productivity, clone stability.

14. The method of claim 8, wherein the specific product attribute is selected from: level of glycosylation, level of charge variance, reduced mismatch, reduced protein/peptide aggregation, protein sequence heterogeneity.

15. A method for generating and high throughput screening a library of targeted integration (TI) host cells expressing at least one sequence of interest (SOI) comprising:
   a) generating a library of TI host cells, wherein said library comprises a plurality of TI host cells expressing one or more SOIs, by:
      i) providing a plurality of TI host cells;
      ii) contacting the plurality of TI host cells with a plurality of vectors, wherein the vectors comprise one or more SOIs;
      iii) introducing the one or more SOIs into a locus of the genome of the one or more of the plurality of TI host cells wherein the locus is at least about 90% homologous to the sequence of NW 006881296.1;
   b) separating said library into single clones; and
   c) screening the clones for a specific cellular or product attribute.

16. The method of claim 15, wherein the one or more SOIs are introduced into one or more of the plurality of TI host cells by recombinase-mediated integration or gene editing-mediated integration.

17. The method of claim 15, wherein the one or more SOIs are operably linked to one or more regulatable promoters.

18. The method of claim 15, wherein the TI host cells are mammalian host cells.

19. The method of claim 15, wherein the SOI encodes a single chain antibody, an antibody light chain, an antibody heavy chain, a single-chain Fv fragment (scFv), or an Fc fusion protein.

20. The method of claim 15, wherein the specific cellular attribute is selected from: cell growth, cell titer, specific productivity, volumetric productivity, clone stability.

21. The method of claim 15, wherein the specific product attribute is selected from: level of glycosylation, level of charge variance, reduced mismatch, reduced protein/peptide aggregation, protein sequence heterogeneity.

22. A method for generating and high throughput screening a library of targeted integration (TI) host cells expressing at least one sequence of interest (SOI) comprising:
   a) generating a library of TI host cells, wherein said library comprises a plurality of TI host cells expressing one or more SOIs, by:
      i) providing a plurality of TI host cells;
      ii) contacting the plurality of TI host cells with a plurality of vectors, wherein the vectors comprise one or more SOIs;
      iii) introducing the one or more SOIs into a locus of the genome of the one or more of the plurality of TI host cells wherein the locus is at least about 90% homologous to the sequence of NW 003616412.1;
   b) separating said library into single clones; and
   c) screening the clones for a specific cellular or product attribute.

23. The method of claim 22, wherein the one or more SOIs are introduced into one or more of the plurality of TI host cells by recombinase-mediated integration or gene editing-mediated integration.

24. The method of claim 22, wherein the one or more SOIs are operably linked to one or more regulatable promoters.

25. The method of claim 22, wherein the TI host cells are mammalian host cells.

26. The method of claim 22, wherein the SOI encodes a single chain antibody, an antibody light chain, an antibody heavy chain, a single-chain Fv fragment (scFv), or an Fc fusion protein.

27. The method of claim 22, wherein the specific cellular attribute is selected from: cell growth, cell titer, specific productivity, volumetric productivity, clone stability.

28. The method of claim 22, wherein the specific product attribute is selected from: level of glycosylation, level of charge variance, reduced mismatch, reduced protein/peptide aggregation, protein sequence heterogeneity.

29. A method for generating and high throughput screening a library of targeted integration (TI) host cells expressing at least one sequence of interest (SOI) comprising:
   a) generating a library of TI host cells, wherein said library comprises a plurality of TI host cells expressing one or more SOIs, by:
      i) providing a plurality of TI host cells;
      ii) contacting the plurality of TI host cells with a plurality of vectors, wherein the vectors comprise one or more SOIs;
      iii) introducing the one or more SOIs into a locus of the genome of the one or more of the plurality of TI host cells wherein the locus is at least about 90% homologous to the sequence of NW 003615063.1;
   b) separating said library into single clones; and
   c) screening the clones for a specific cellular or product attribute.

30. The method of claim 29, wherein the one or more SOIs are introduced into one or more of the plurality of TI host cells by recombinase-mediated integration or gene editing-mediated integration.

31. The method of claim 29, wherein the one or more SOIs are operably linked to one or more regulatable promoters.

32. The method of claim 29, wherein the TI host cells are mammalian host cells.

33. The method of claim 29, wherein the SOI encodes a single chain antibody, an antibody light chain, an antibody heavy chain, a single-chain Fv fragment (scFv), or an Fc fusion protein.

34. The method of claim 29, wherein the specific cellular attribute is selected from: cell growth, cell titer, specific productivity, volumetric productivity, clone stability.

35. The method of claim 29, wherein the specific product attribute is selected from: level of glycosylation, level of charge variance, reduced mismatch, reduced protein/peptide aggregation, protein sequence heterogeneity.

36. A method for generating and high throughput screening a library of targeted integration (TI) host cells expressing at least one sequence of interest (SOI) comprising:
   a) generating a library of TI host cells, wherein said library comprises a plurality of TI host cells expressing one or more SOIs, by:
      i) providing a plurality of TI host cells;
      ii) contacting the plurality of TI host cells with a plurality of vectors, wherein the vectors comprise one or more SOIs;
      iii) introducing the one or more SOIs into a locus of the genome of the one or more of the plurality of TI host cells wherein the locus is at least about 90% homologous to the sequence of NW 006882936.1;
   b) separating said library into single clones; and
   c) screening the clones for a specific cellular or product attribute.

37. The method of claim 36, wherein the one or more SOIs are introduced into one or more of the plurality of TI host cells by recombinase-mediated integration or gene editing-mediated integration.

38. The method of claim 36, wherein the one or more SOIs are operably linked to one or more regulatable promoters.

39. The method of claim 36, wherein the TI host cells are mammalian host cells.

40. The method of claim 36, wherein the SOI encodes a single chain antibody, an antibody light chain, an antibody heavy chain, a single-chain Fv fragment (scFv), or an Fc fusion protein.

41. The method of claim 36, wherein the specific cellular attribute is selected from: cell growth, cell titer, specific productivity, volumetric productivity, clone stability.

42. The method of claim 36, wherein the specific product attribute is selected from: level of glycosylation, level of charge variance, reduced mismatch, reduced protein/peptide aggregation, protein sequence heterogeneity.

43. A method for generating and high throughput screening a library of targeted integration (TI) host cells expressing at least one sequence of interest (SOI) comprising:
   a) generating a library of TI host cells, wherein said library comprises a plurality of TI host cells expressing one or more SOIs, by:
      i) providing a plurality of TI host cells;
      ii) contacting the plurality of TI host cells with a plurality of vectors, wherein the vectors comprise one or more SOIs;
      iii) introducing the one or more SOIs into a locus of the genome of the one or more of the plurality of TI host cells wherein the locus is at least about 90% homologous to the sequence of NW 003615411.1;
   b) separating said library into single clones; and
   c) screening the clones for a specific cellular or product attribute.

44. The method of claim 43, wherein the one or more SOIs are introduced into one or more of the plurality of TI host cells by recombinase-mediated integration or gene editing-mediated integration.

45. The method of claim 43, wherein the one or more SOIs are operably linked to one or more regulatable promoters.

46. The method of claim 43, wherein the TI host cells are mammalian host cells.

47. The method of claim 43, wherein the SOI encodes a single chain antibody, an antibody light chain, an antibody heavy chain, a single-chain Fv fragment (scFv), or an Fc fusion protein.

48. The method of claim 43, wherein the specific cellular attribute is selected from: cell growth, cell titer, specific productivity, volumetric productivity, clone stability.

49. The method of claim 43, wherein the specific product attribute is selected from: level of glycosylation, level of charge variance, reduced mismatch, reduced protein/peptide aggregation, protein sequence heterogeneity.

* * * * *